(12) United States Patent (10) Patent No.: US 9,365,850 B2
Brown et al. (45) Date of Patent: Jun. 14, 2016

(54) METHODS AND COMPOSITIONS FOR THE SPECIFIC INHIBITION OF MYC BY DOUBLE-STRANDED RNA

(71) Applicant: Dicerna Pharmaceuticals, Inc., Watertown, MA (US)

(72) Inventors: Bob D. Brown, Millington, NJ (US); Henryk T. Dudek, Wellesley, MA (US)

(73) Assignee: Dicerna Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 14/025,009

(22) Filed: Sep. 12, 2013

(65) Prior Publication Data

US 2014/0107178 A1 Apr. 17, 2014

Related U.S. Application Data

(60) Provisional application No. 61/701,136, filed on Sep. 14, 2012, provisional application No. 61/786,695, filed on Mar. 15, 2013.

(51) Int. Cl.
 *A61K 31/7115* (2006.01)
 *C12N 15/113* (2010.01)

(52) U.S. Cl.
 CPC .......... *C12N 15/113* (2013.01); *C12N 15/1135* (2013.01); *C12N 2310/14* (2013.01); *C12N 2310/3181* (2013.01); *C12N 2310/321* (2013.01); *C12N 2310/3233* (2013.01); *C12N 2310/533* (2013.01); *C12N 2330/30* (2013.01)

(58) Field of Classification Search
 USPC .............. 435/6.1, 91.1, 91.31, 455, 458, 375; 514/44; 536/23.1, 24.5
 See application file for complete search history.

(56) References Cited

U.S. PATENT DOCUMENTS

| | | | |
|---|---|---|---|
| 7,893,248 B2 * | 2/2011 | McSwiggen et al. | ........ 536/24.5 |
| 7,951,935 B2 | 5/2011 | Khvorova et al. | |
| 8,124,752 B2 | 2/2012 | Bumcrot et al. | |
| 2007/0190532 A1 * | 8/2007 | Katelic et al. | ..................... 435/6 |
| 2010/0055782 A1 | 3/2010 | Quay et al. | |
| 2010/0093835 A1 | 4/2010 | McSwiggen et al. | |
| 2012/0015899 A1 | 1/2012 | Lomonossoff et al. | |

FOREIGN PATENT DOCUMENTS

| | | |
|---|---|---|
| WO | 2008008719 A2 | 1/2008 |
| WO | 2009009739 A2 | 1/2009 |
| WO | 2009029293 A2 | 1/2009 |
| WO | 2009152387 A2 | 12/2009 |
| WO | 2010121269 A1 | 10/2010 |
| WO | 2010135669 A1 | 11/2010 |
| WO | 2011029914 A1 | 3/2011 |
| WO | 2012055170 A1 | 5/2012 |

OTHER PUBLICATIONS

NCBI, GenBank accession No. NM_002467.4 (Jul. 29, 2012) (5 pages).
Kovancilar, MGE et al., "Testing the putative effect of dicer-substrate siRNAs in regulating gene expression at transcriptional level", Turkish Journal of Biology, 2011, vol. 35, No. 4, pp. 399-404 (7 pages).
International Search Report for corresponding International Application Ser. No. PCT/US2013/059391, filed Sep. 12, 2013, 11 pages.
Written Opinion for corresponding International Application Ser. No. PCT/US2013/059391, filed Sep. 12, 2013, 12 pages.
Notification Concerning Transmittal of International Preliminary Report on Patentability issued in corresponding PCT/US2013/059391, Mar. 17, 2015, 13 pages.

* cited by examiner

*Primary Examiner* — Jane Zara
(74) *Attorney, Agent, or Firm* — Mintz Levin Cohn Ferris Glovsky and Popeo, P.C.; Christopher R. Cowles

(57) ABSTRACT

This invention relates to compounds, compositions, and methods useful for reducing MYC target RNA and protein levels via use of dsRNAs, e.g., Dicer substrate siRNA (DsiRNA) agents.

51 Claims, 49 Drawing Sheets

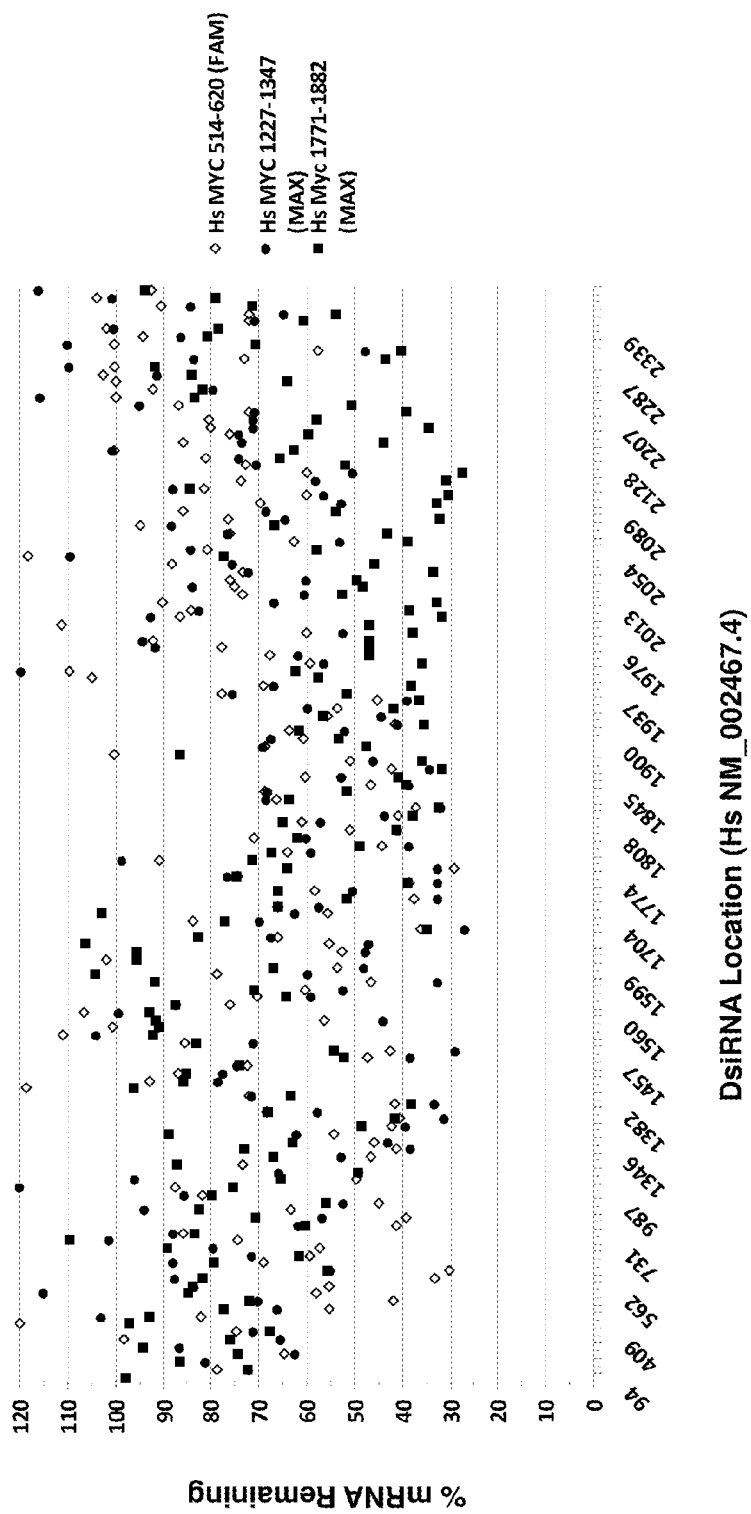

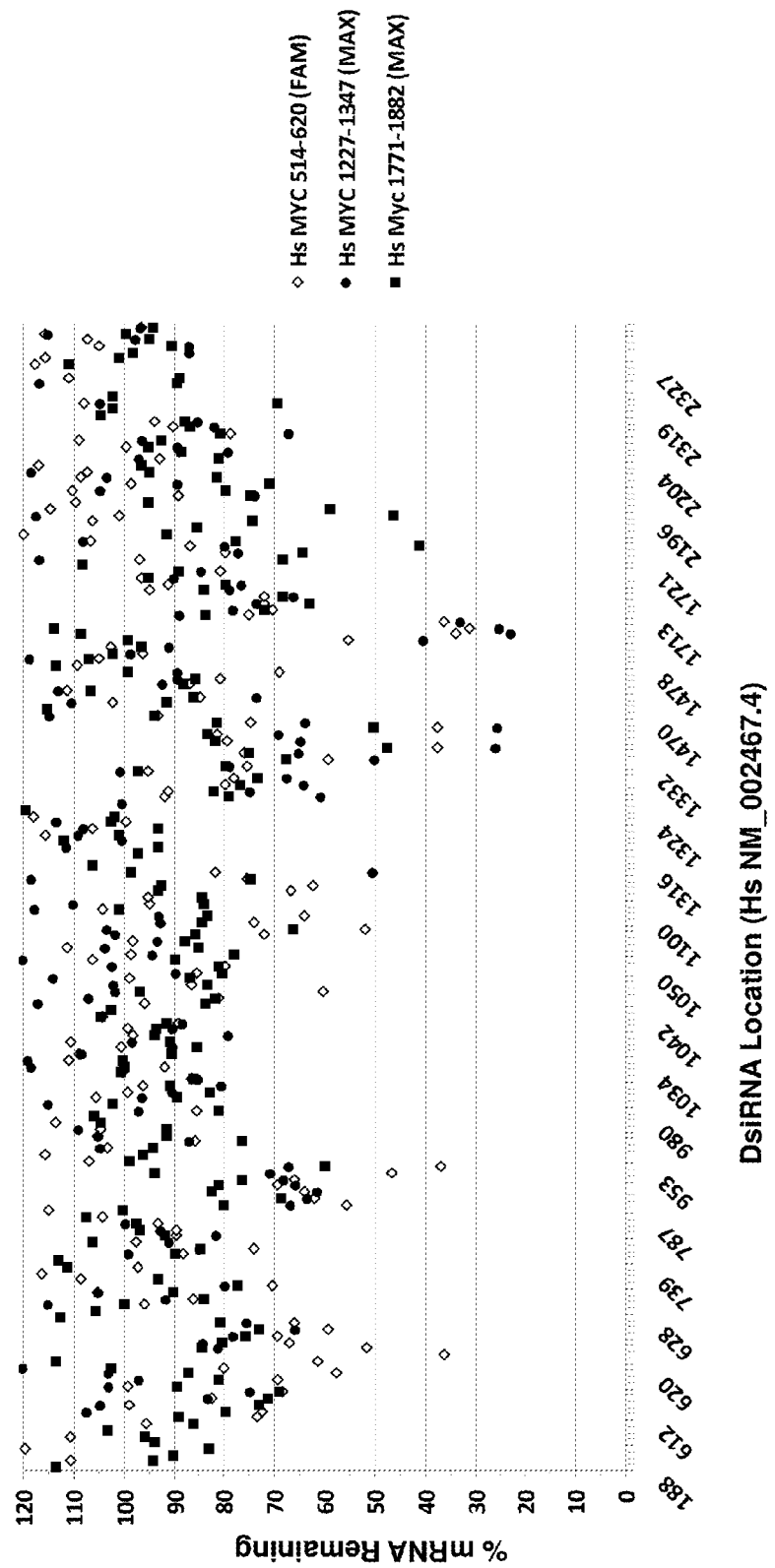

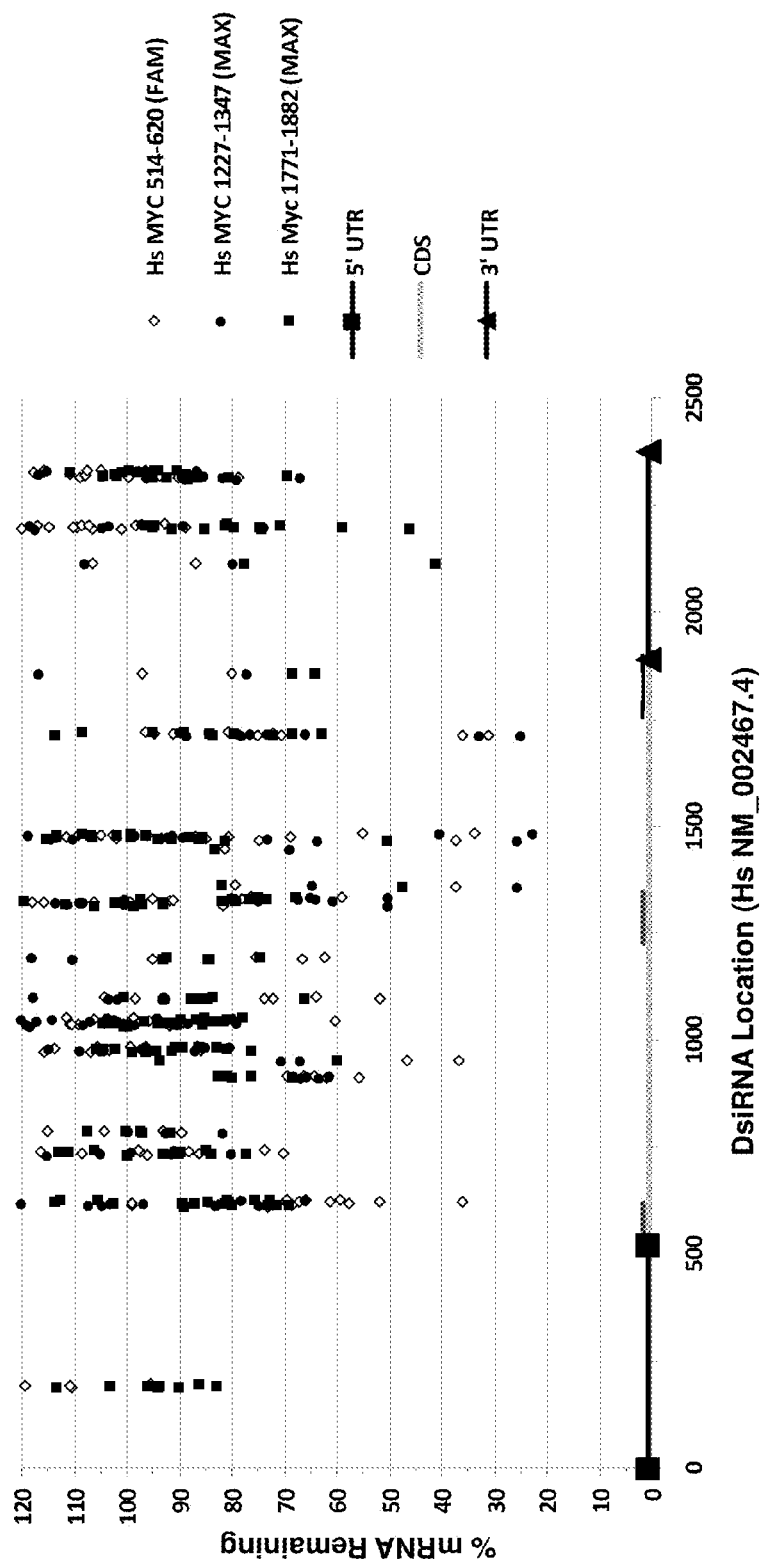

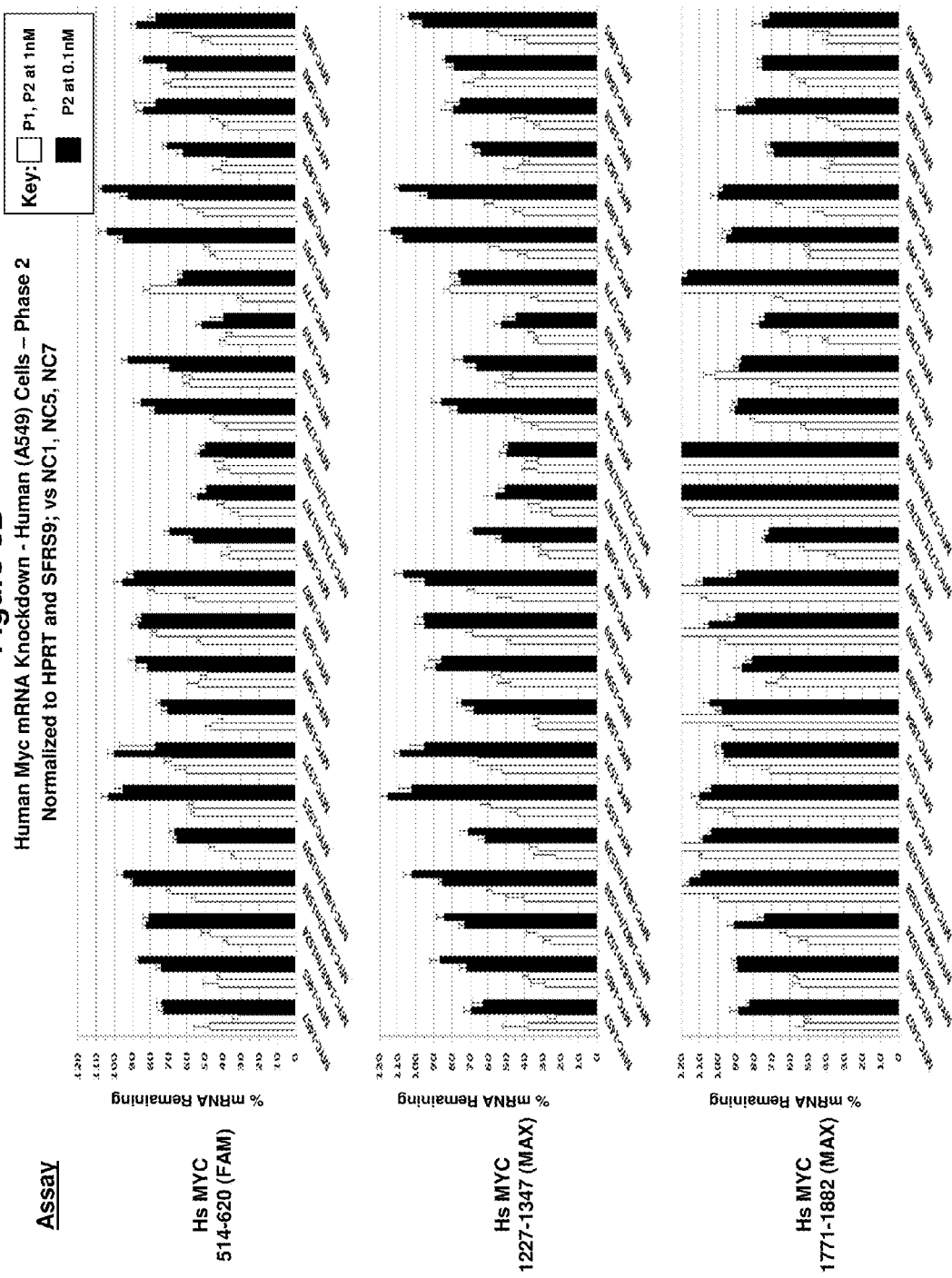

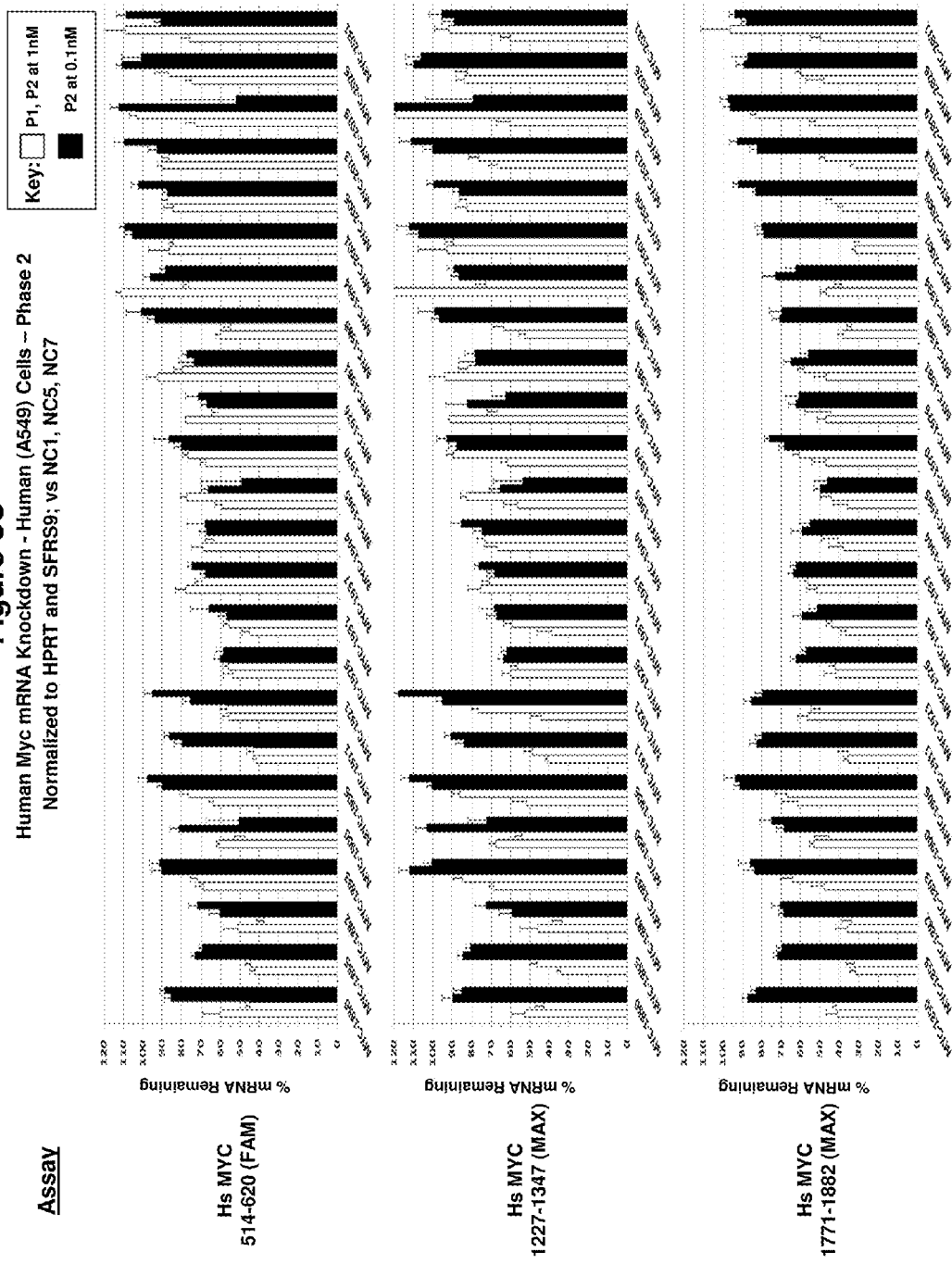

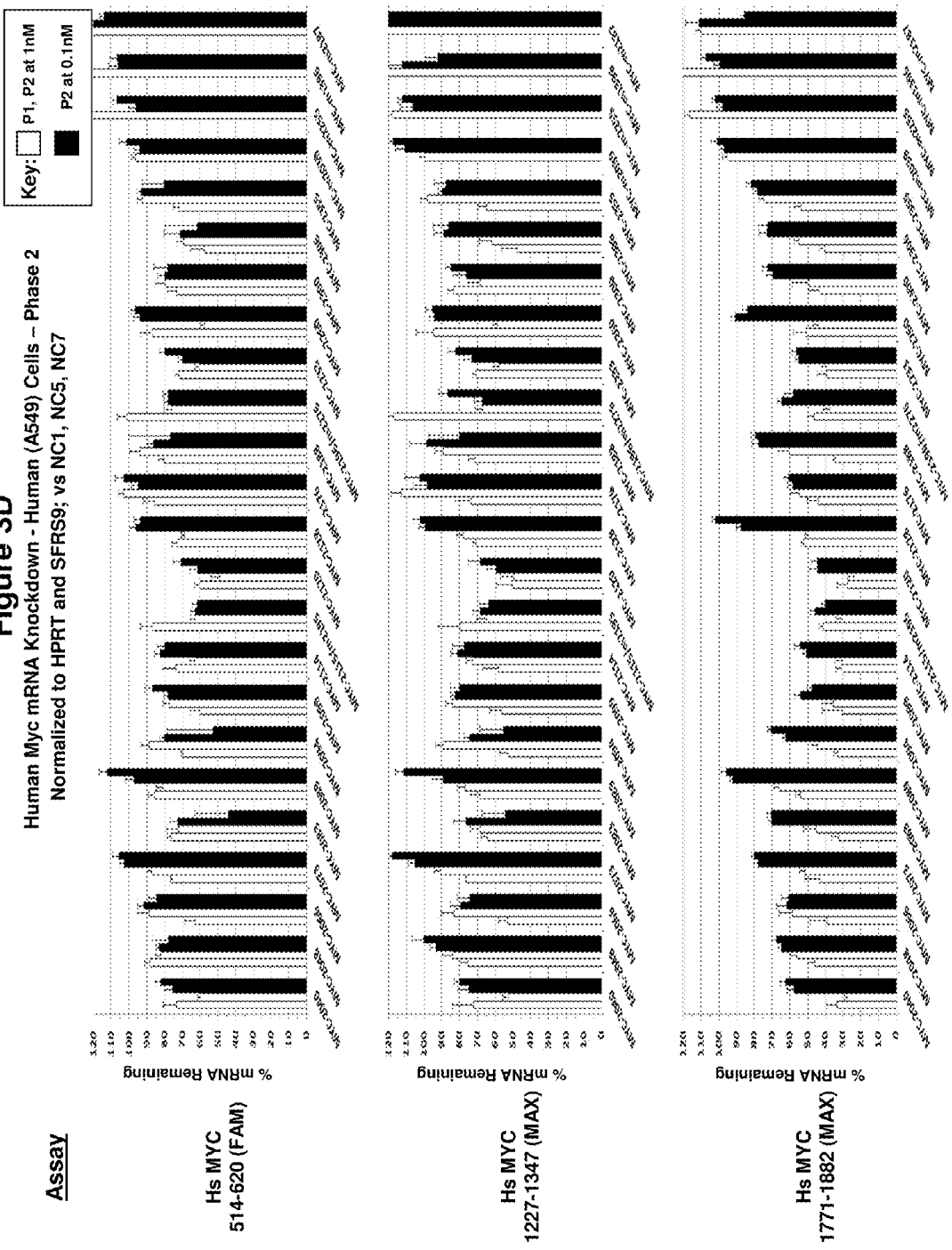

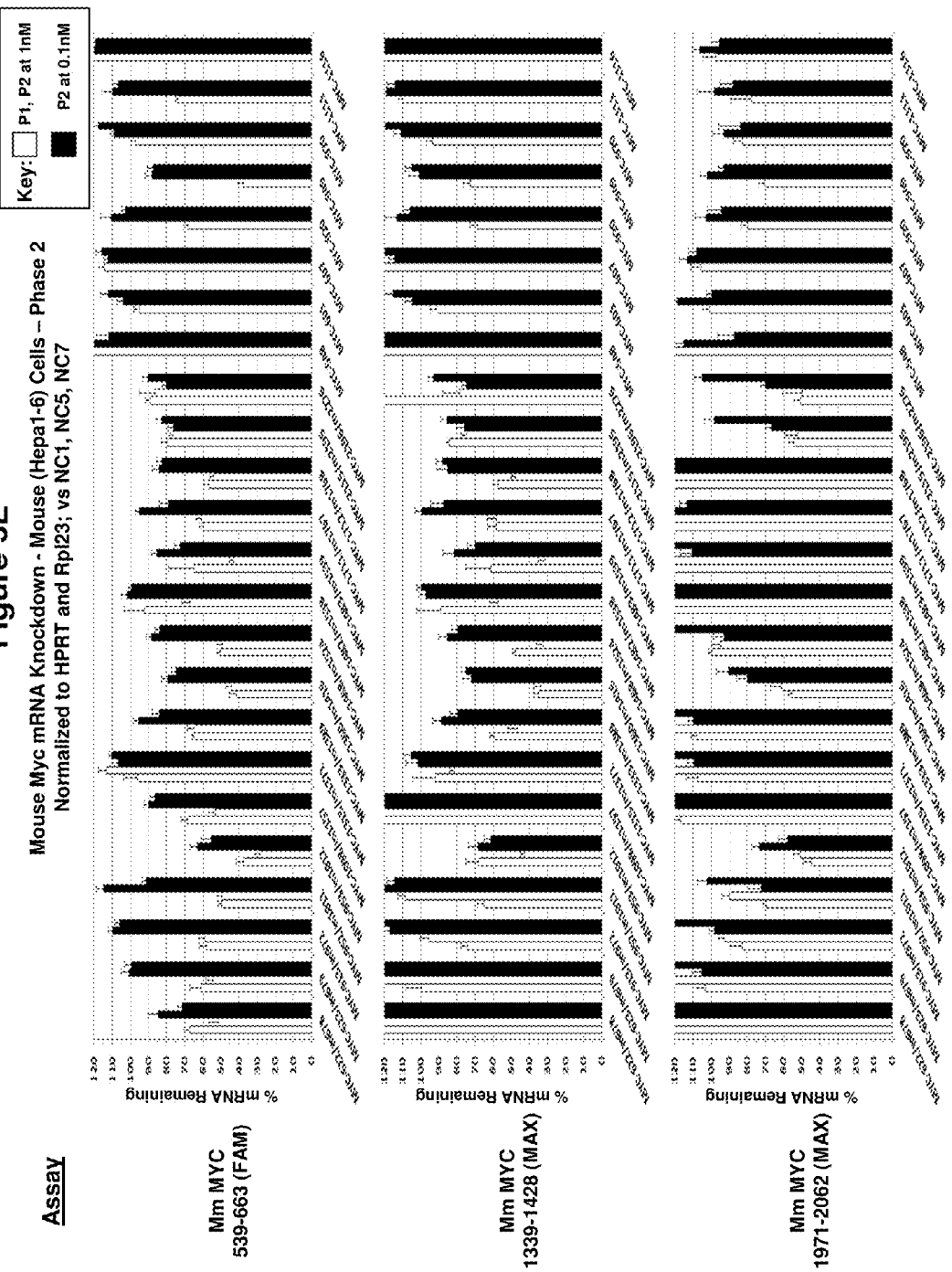

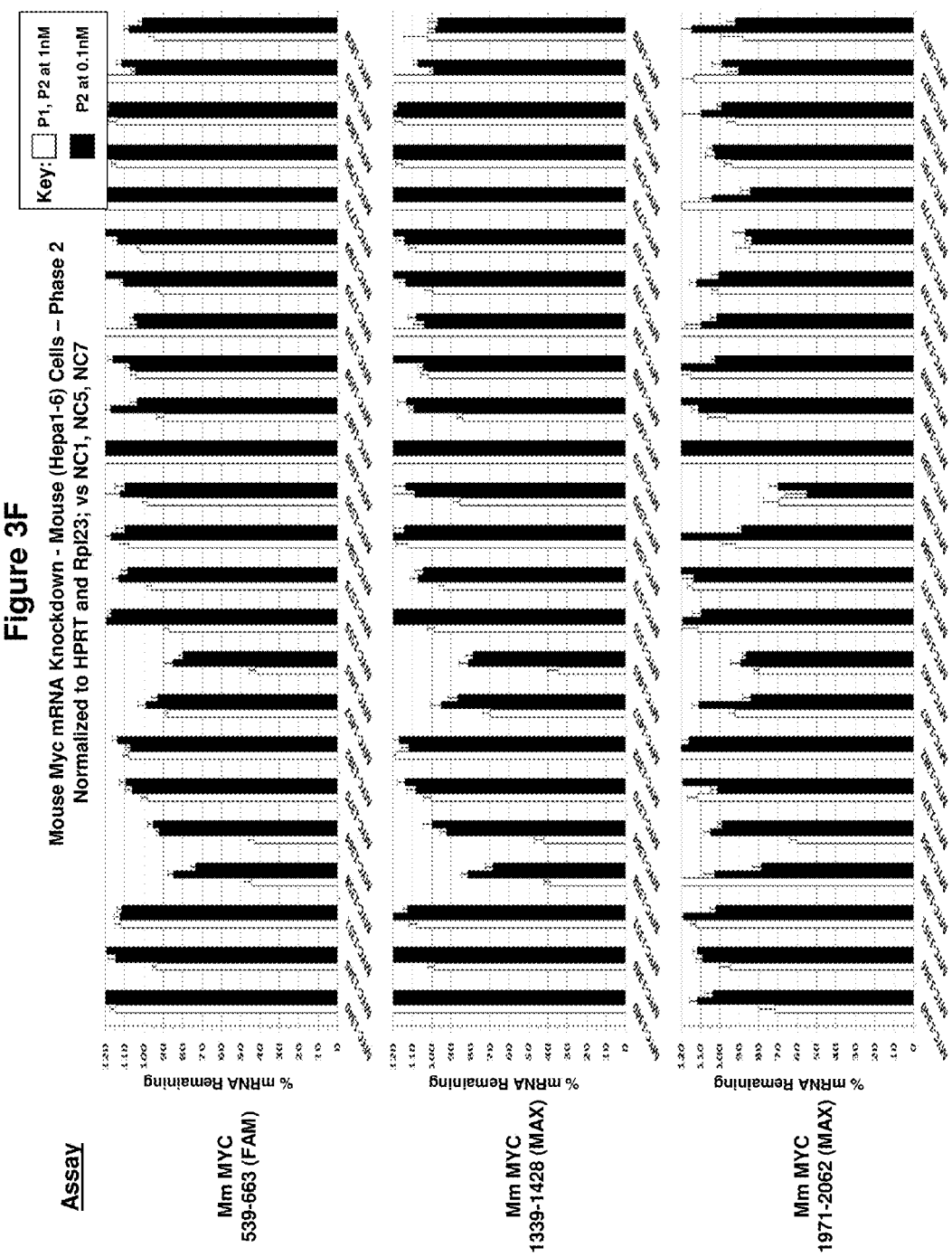

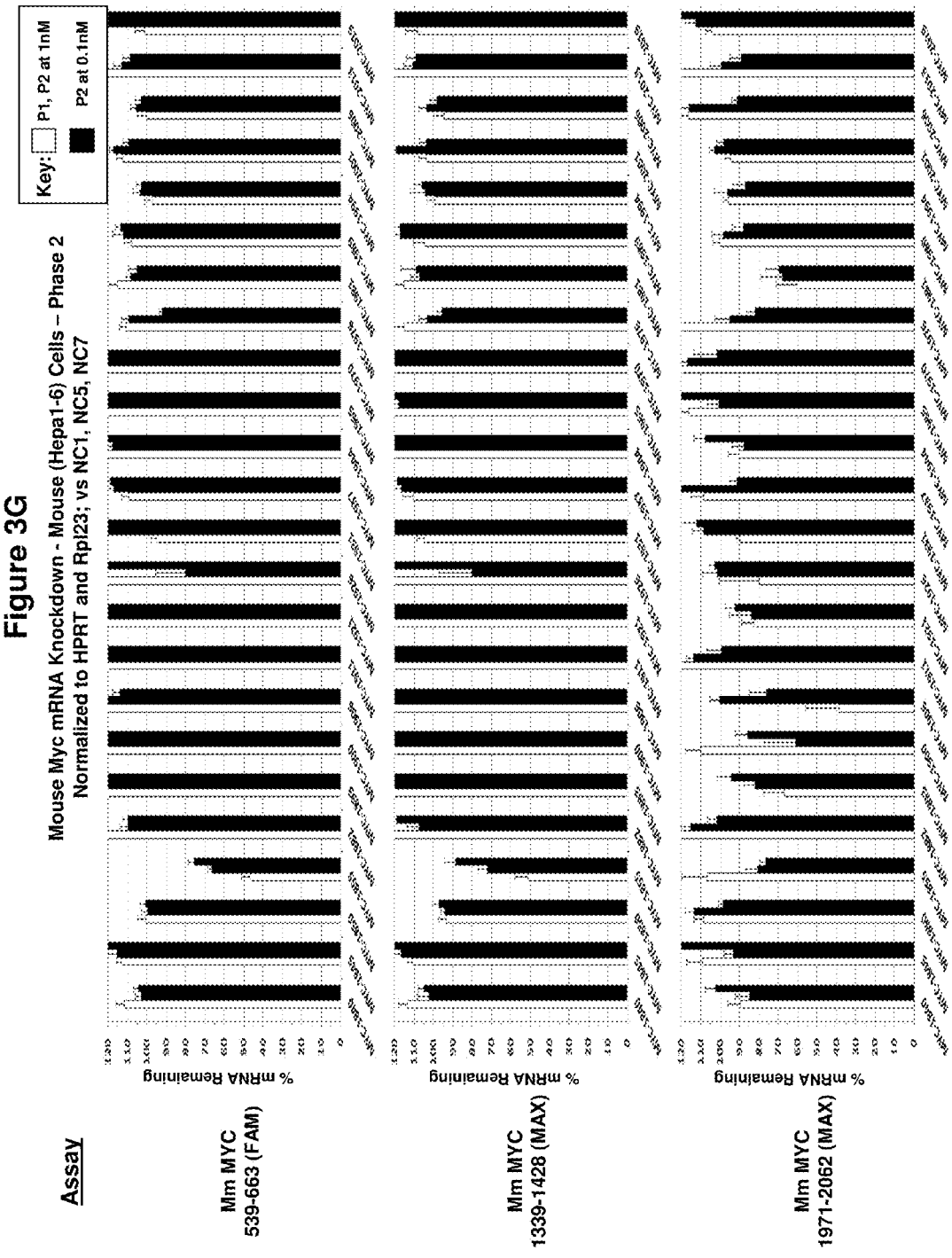

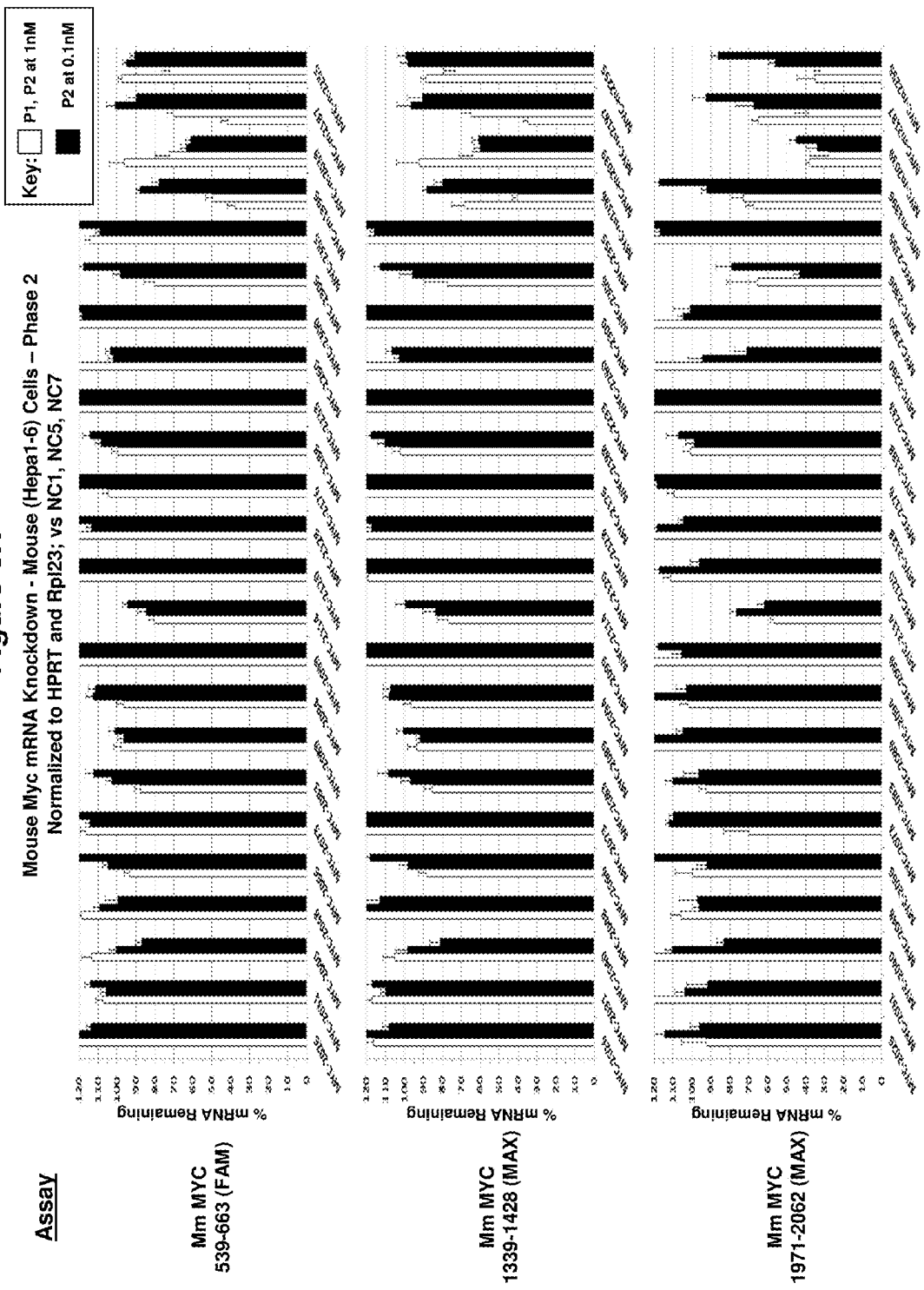

Human Myc mRNA Knockdown - Human (A549) Cells – Phase 3
Normalized to HPRT and SFRS9; vs NC1, NC5, NC7

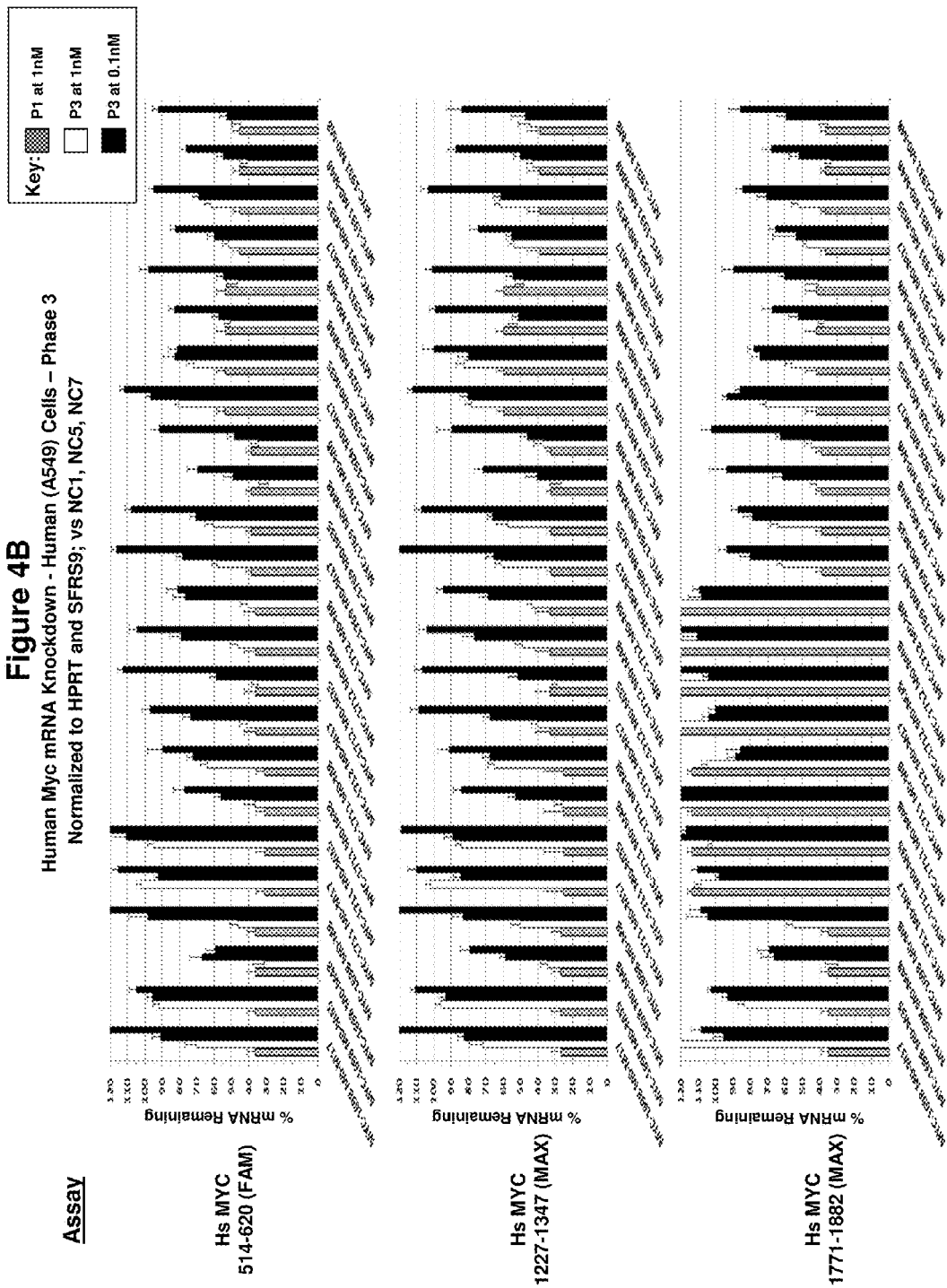

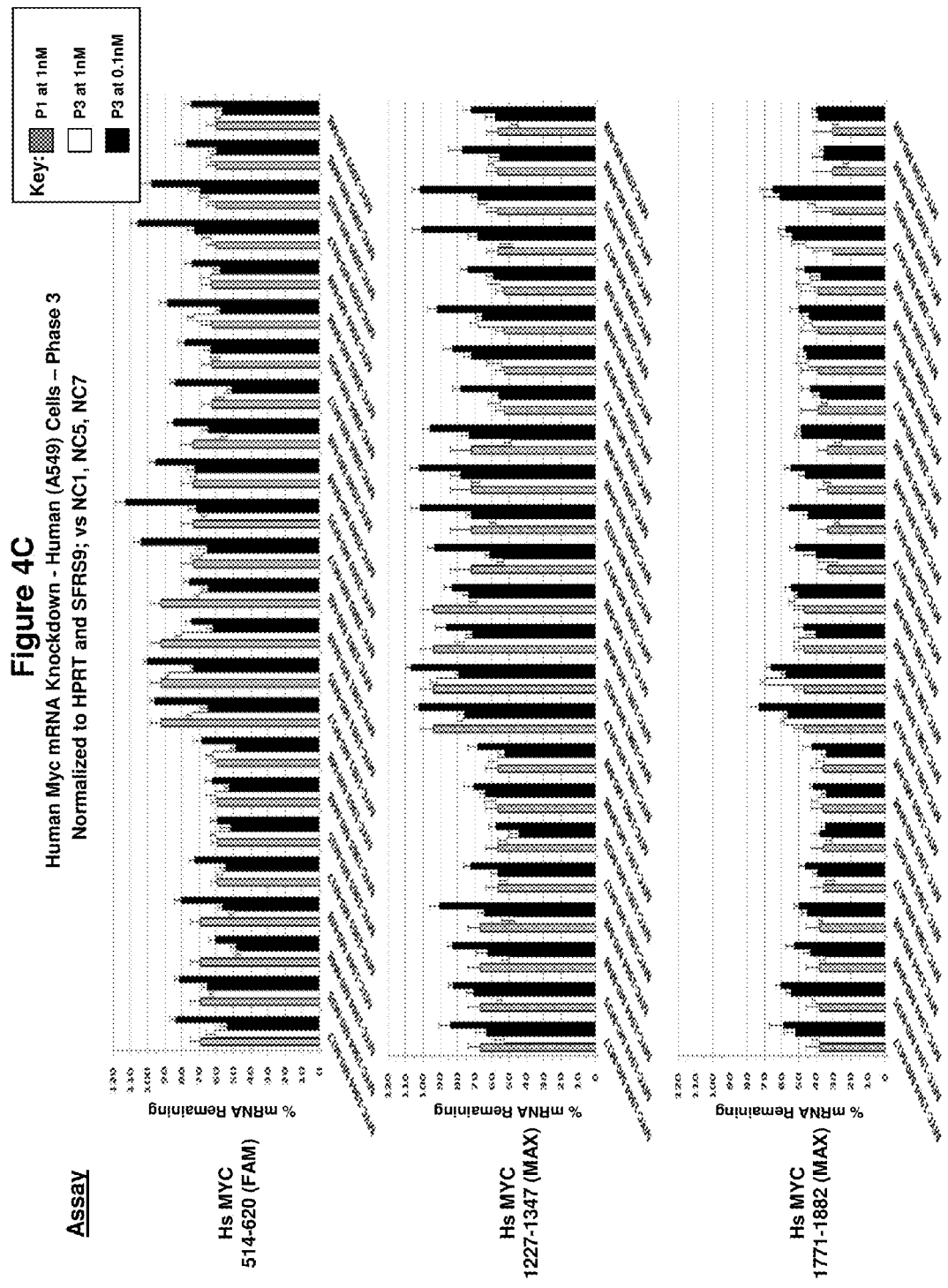

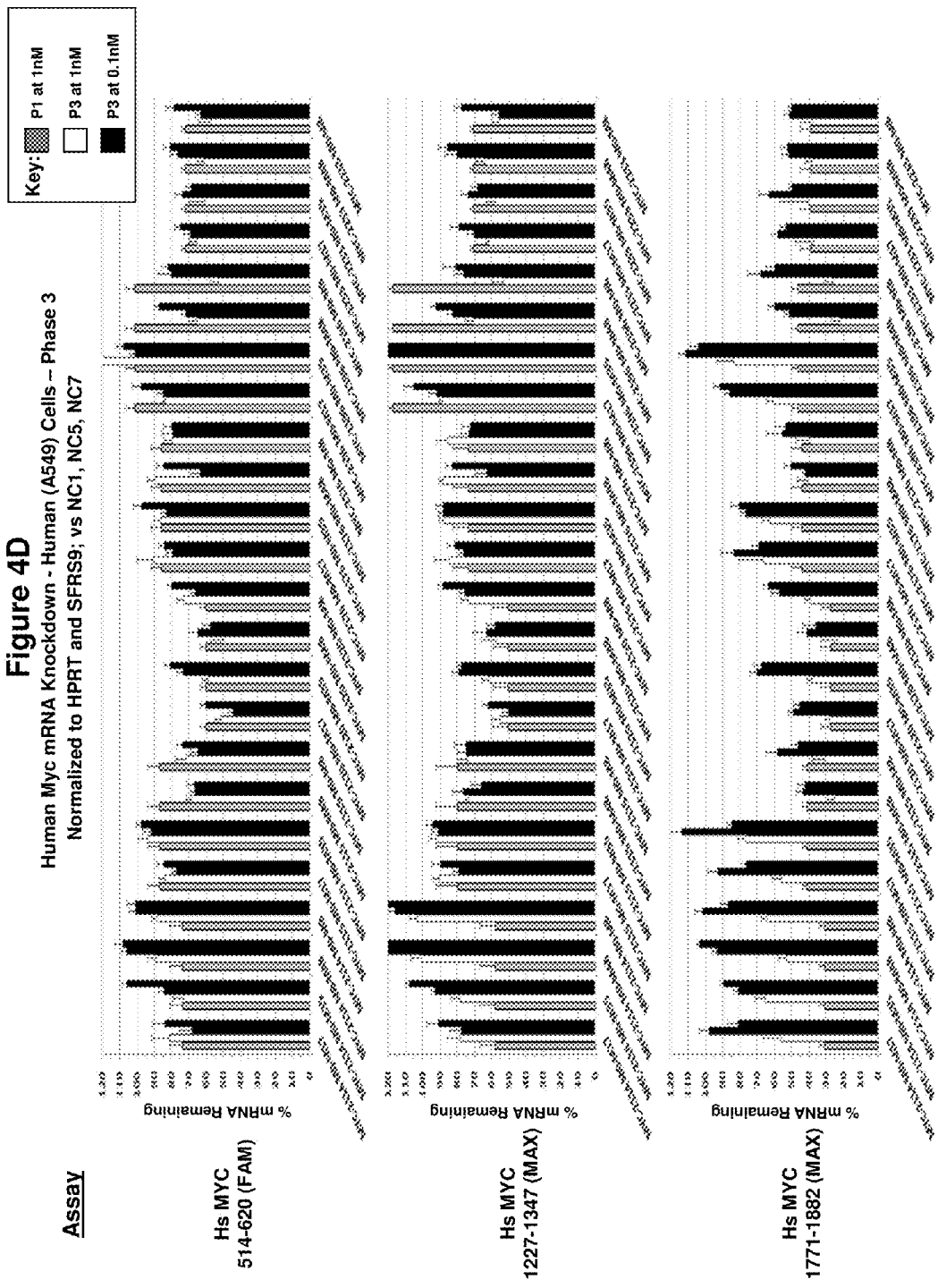

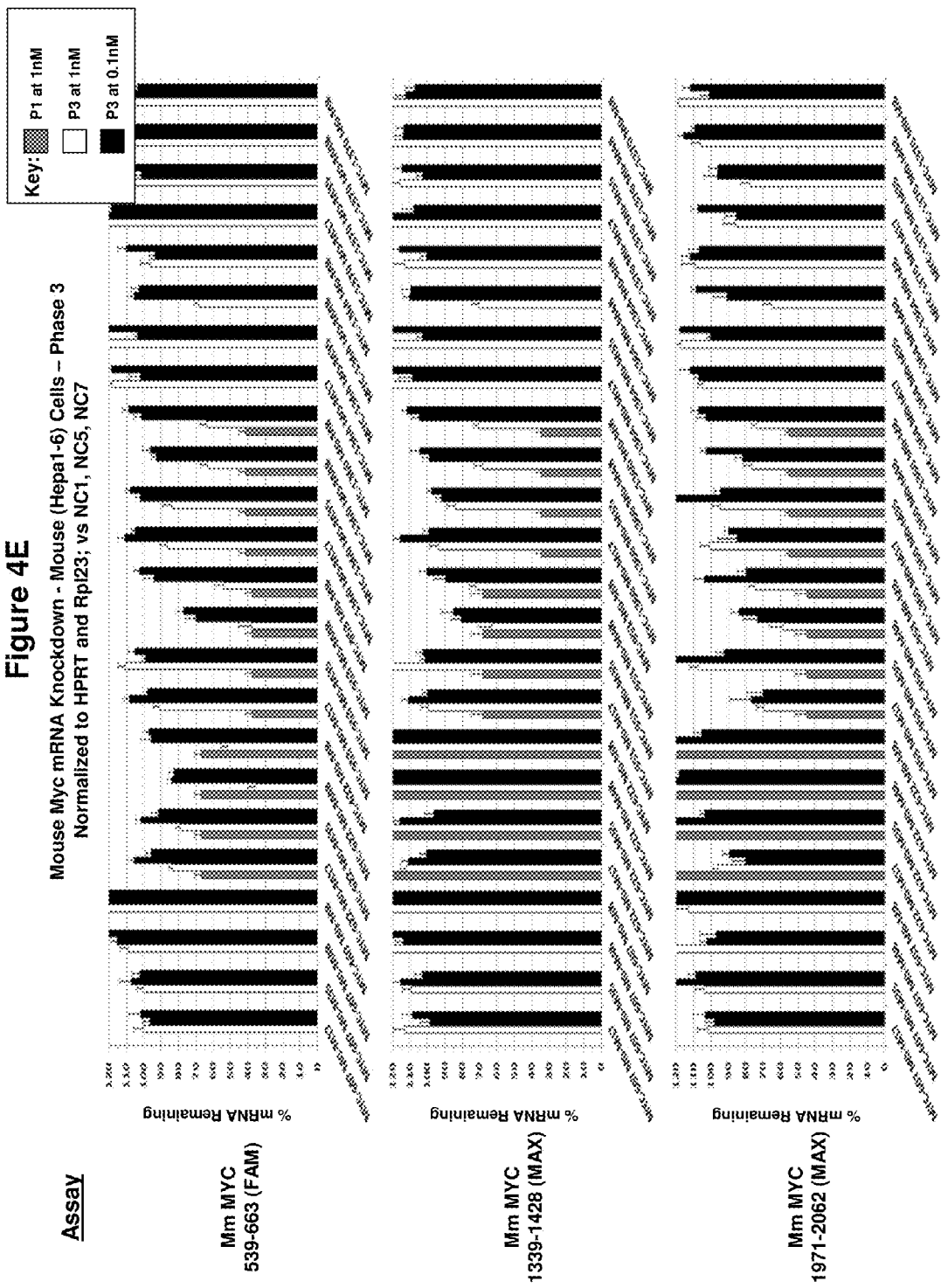

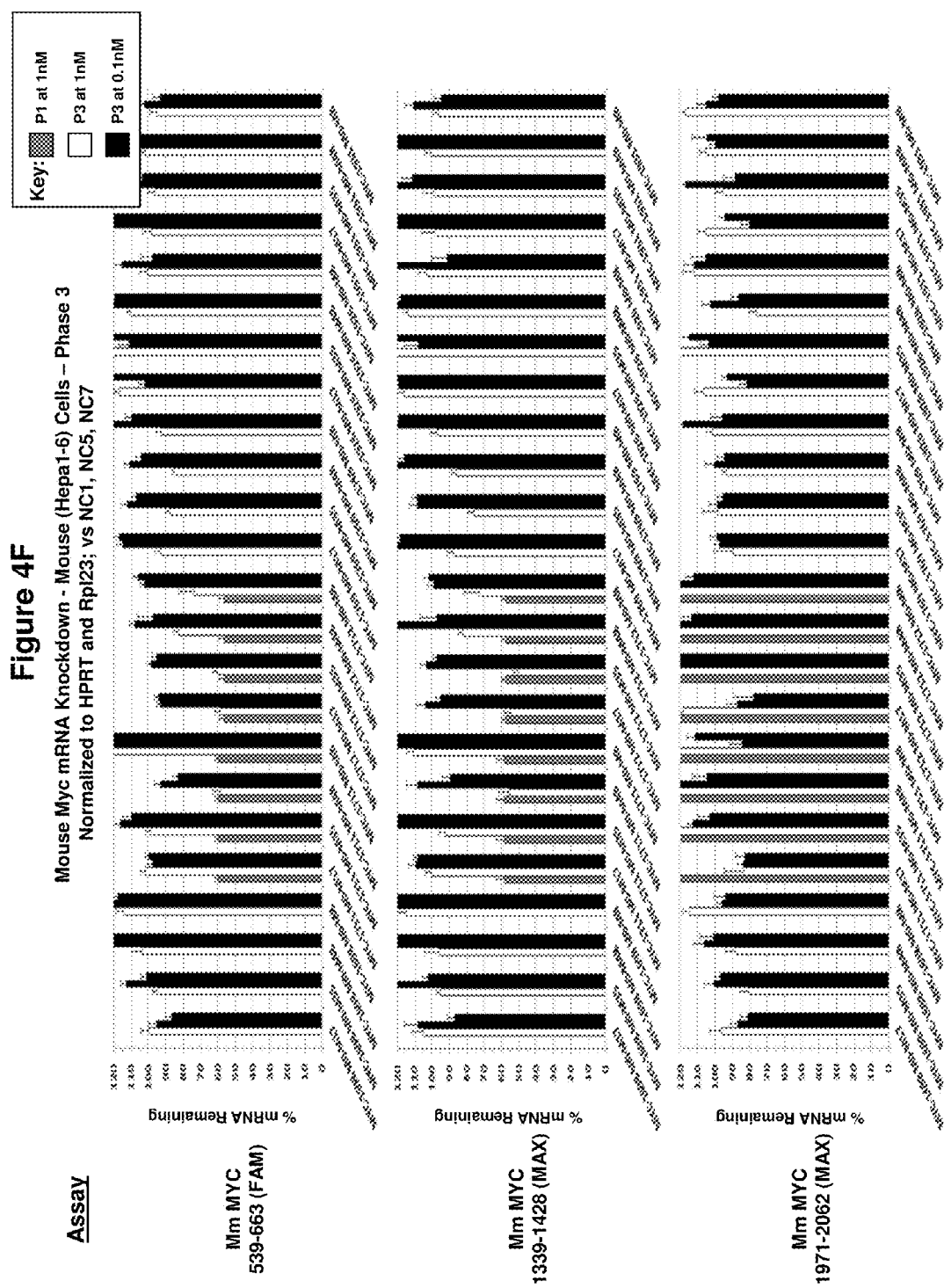

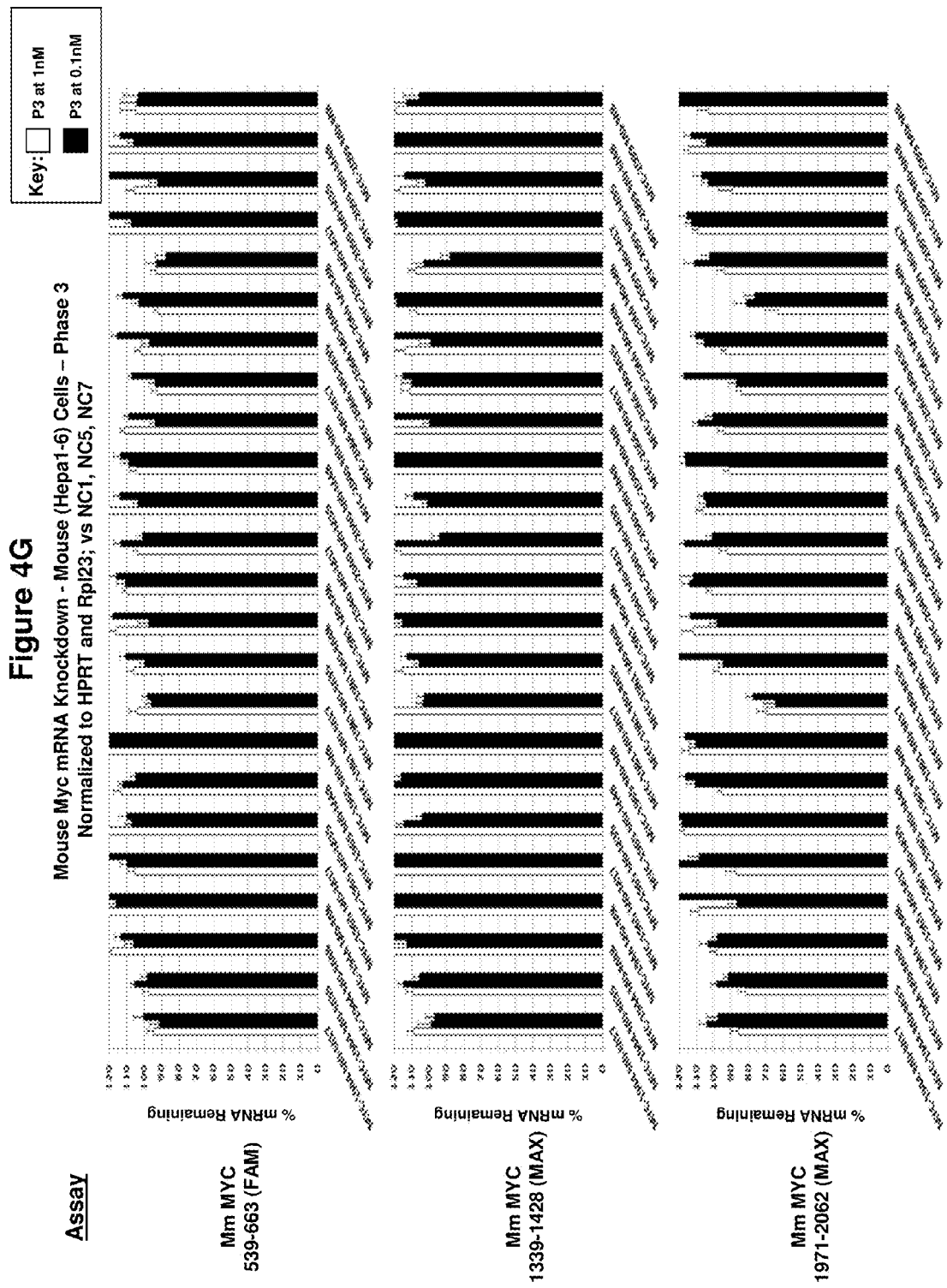

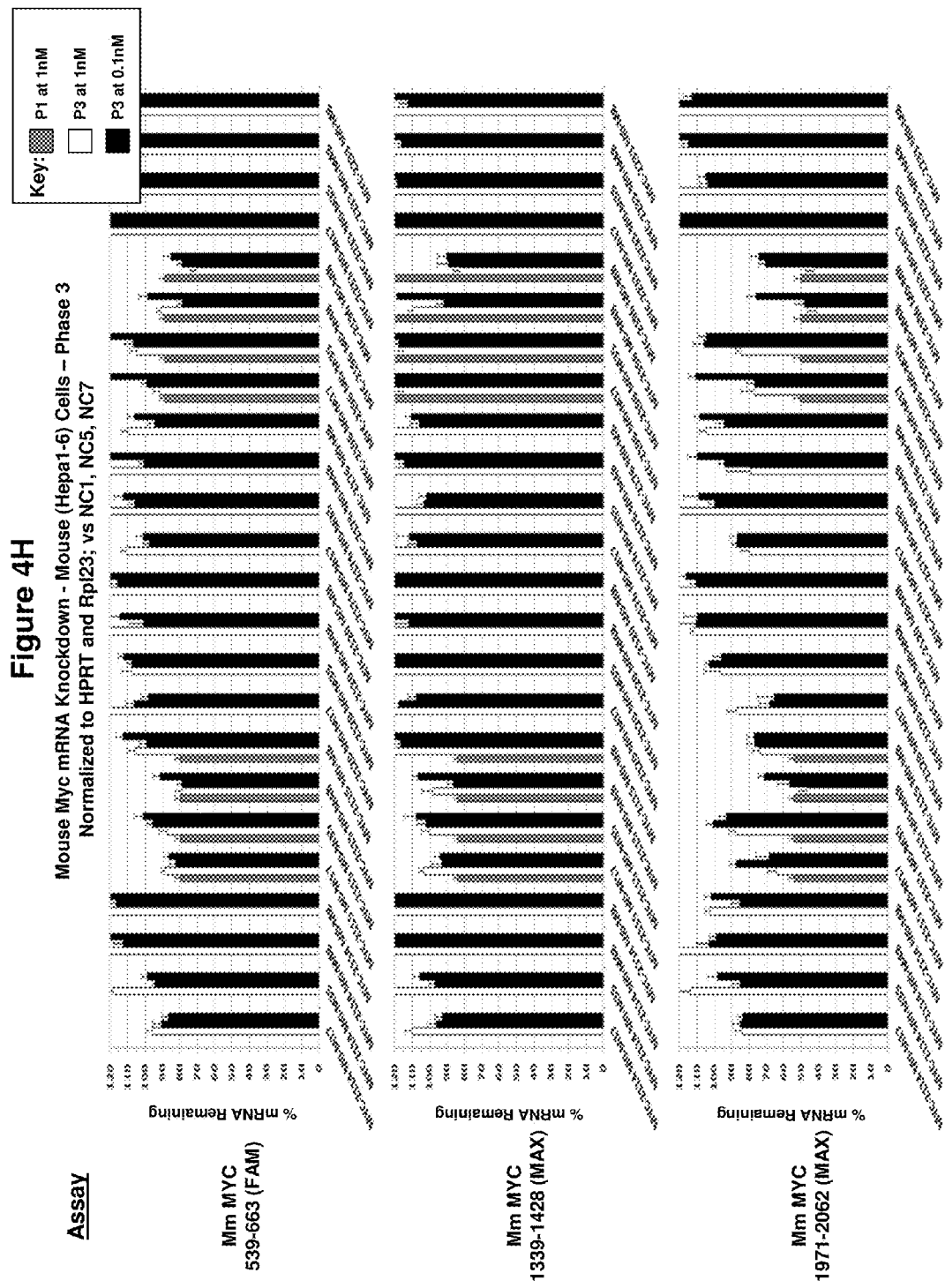

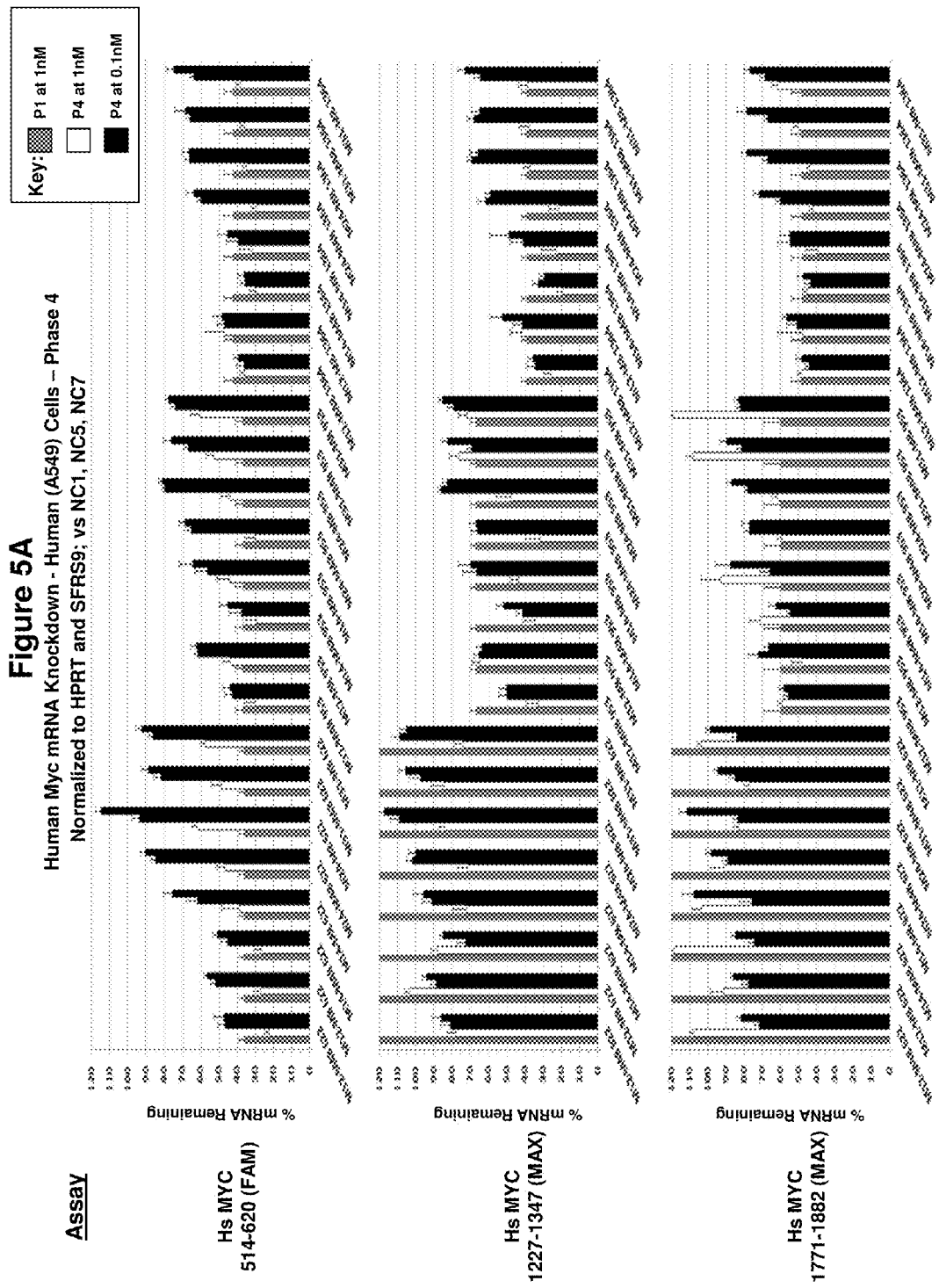

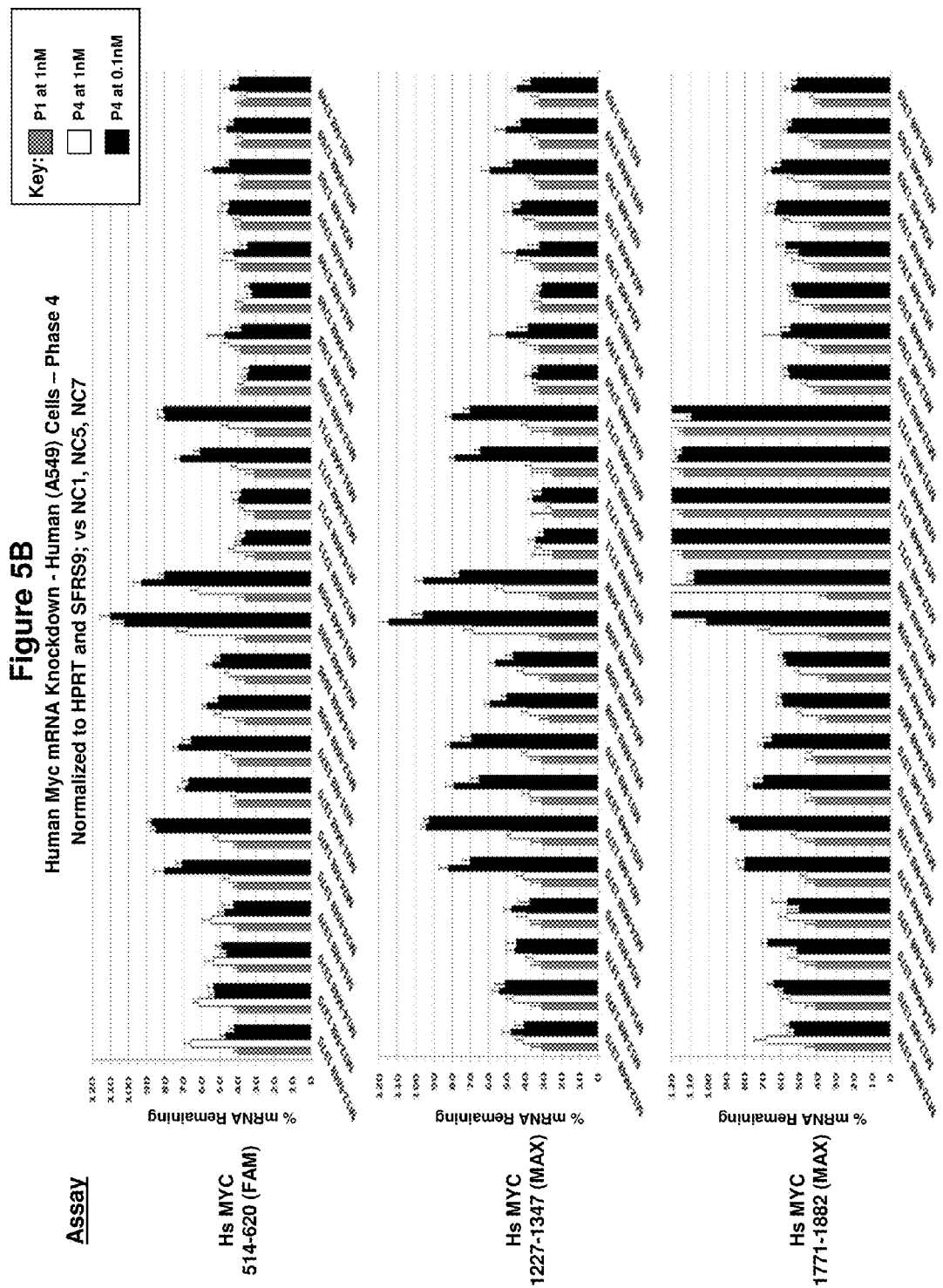

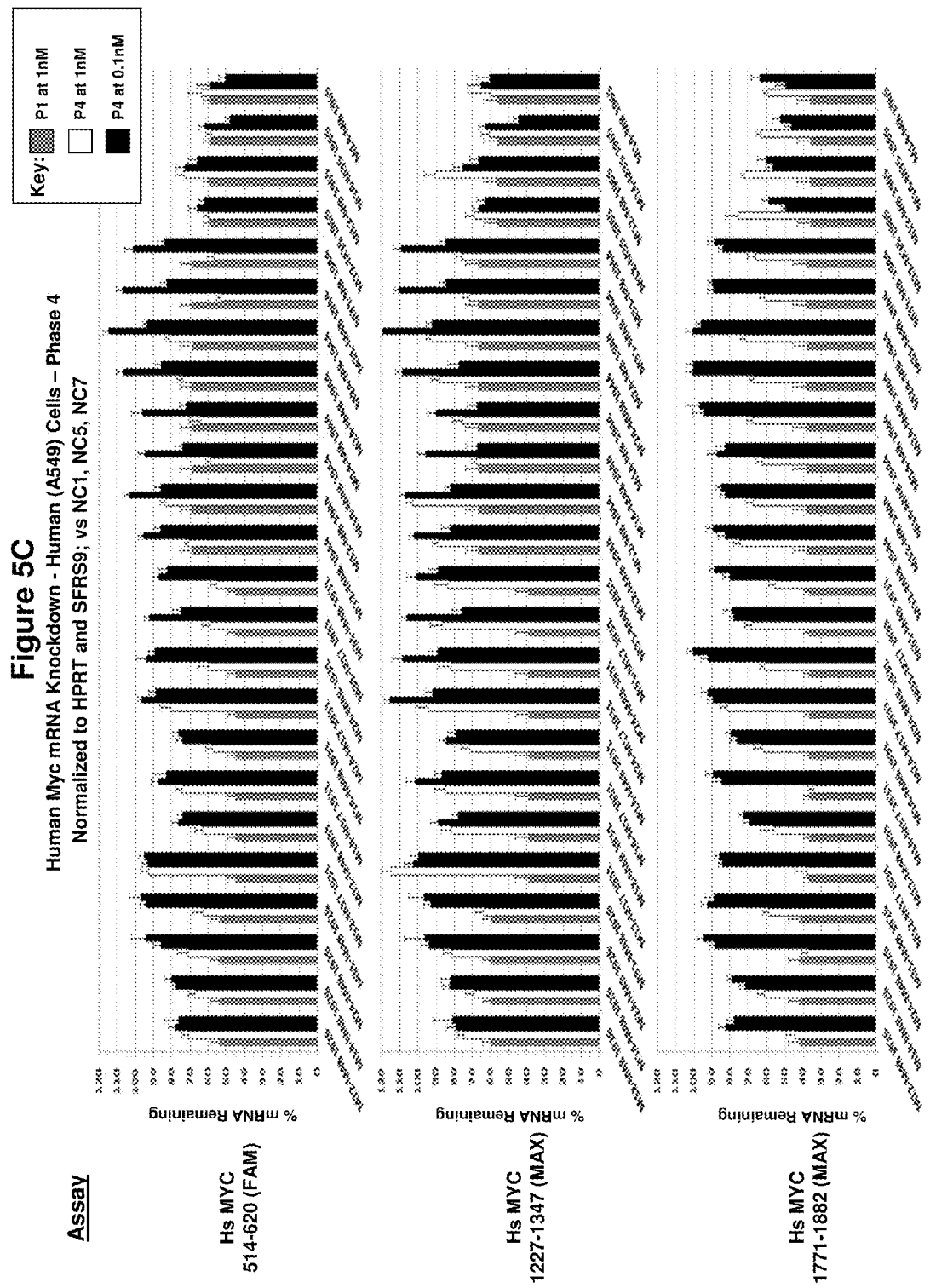

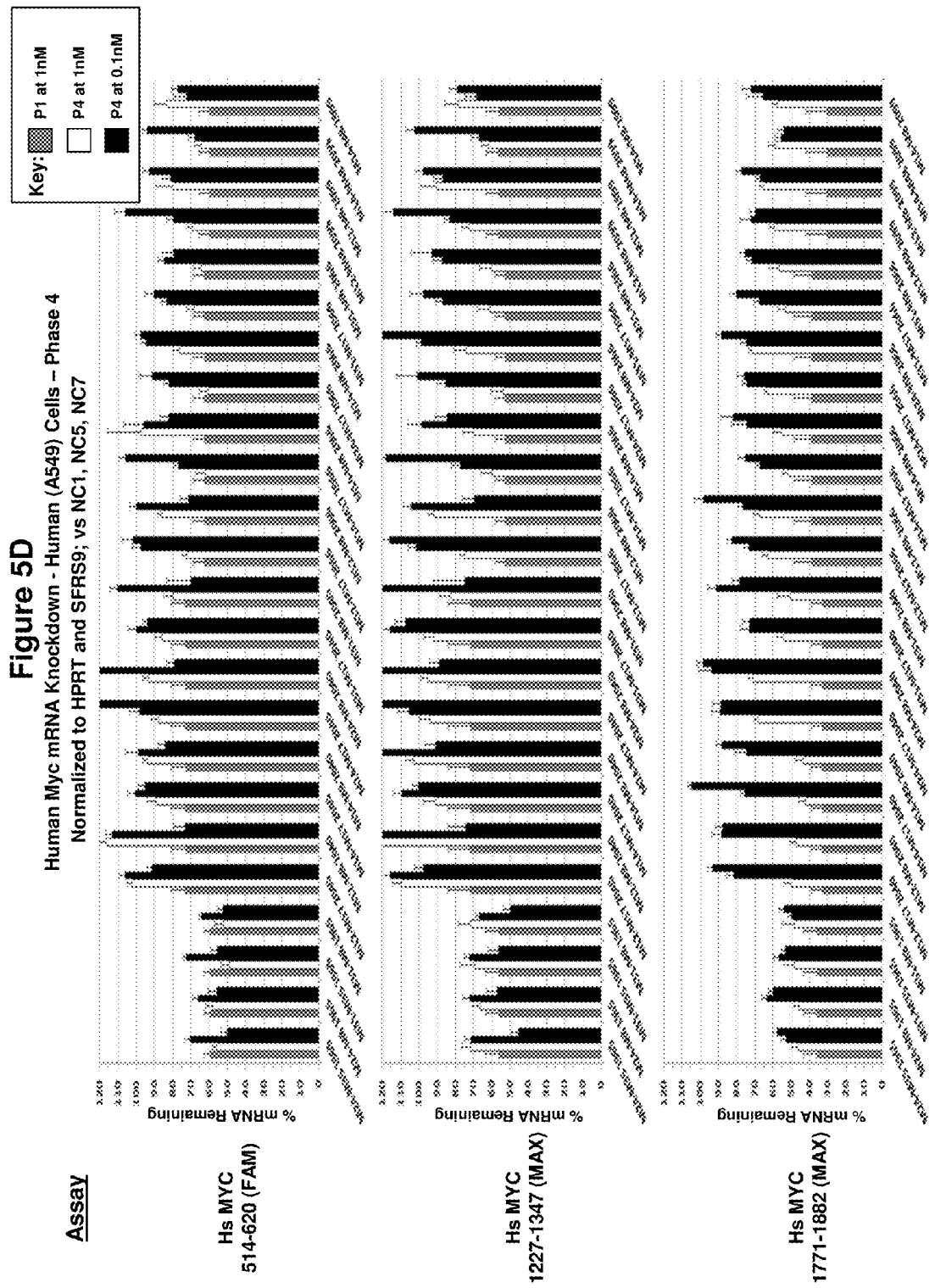

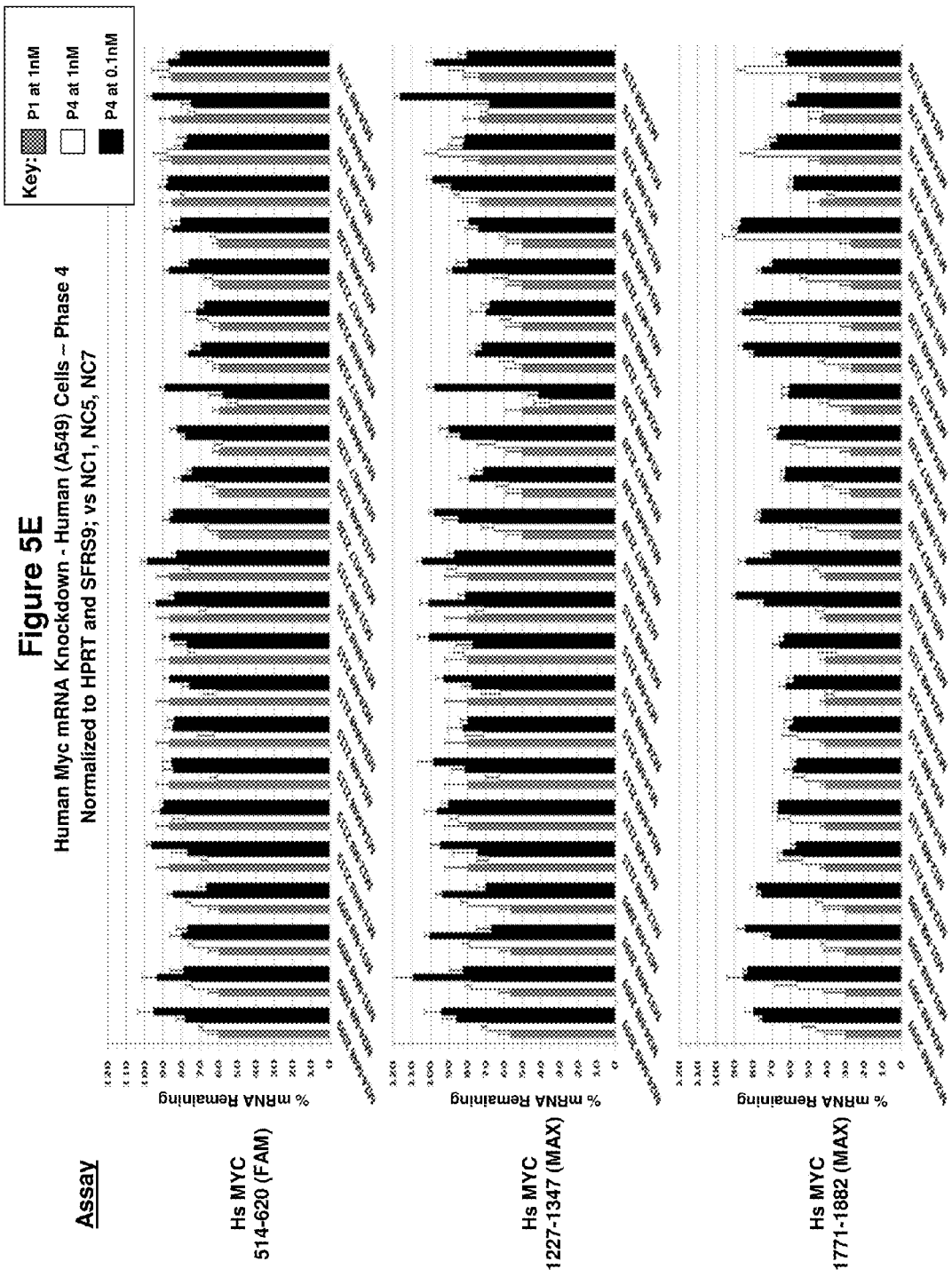

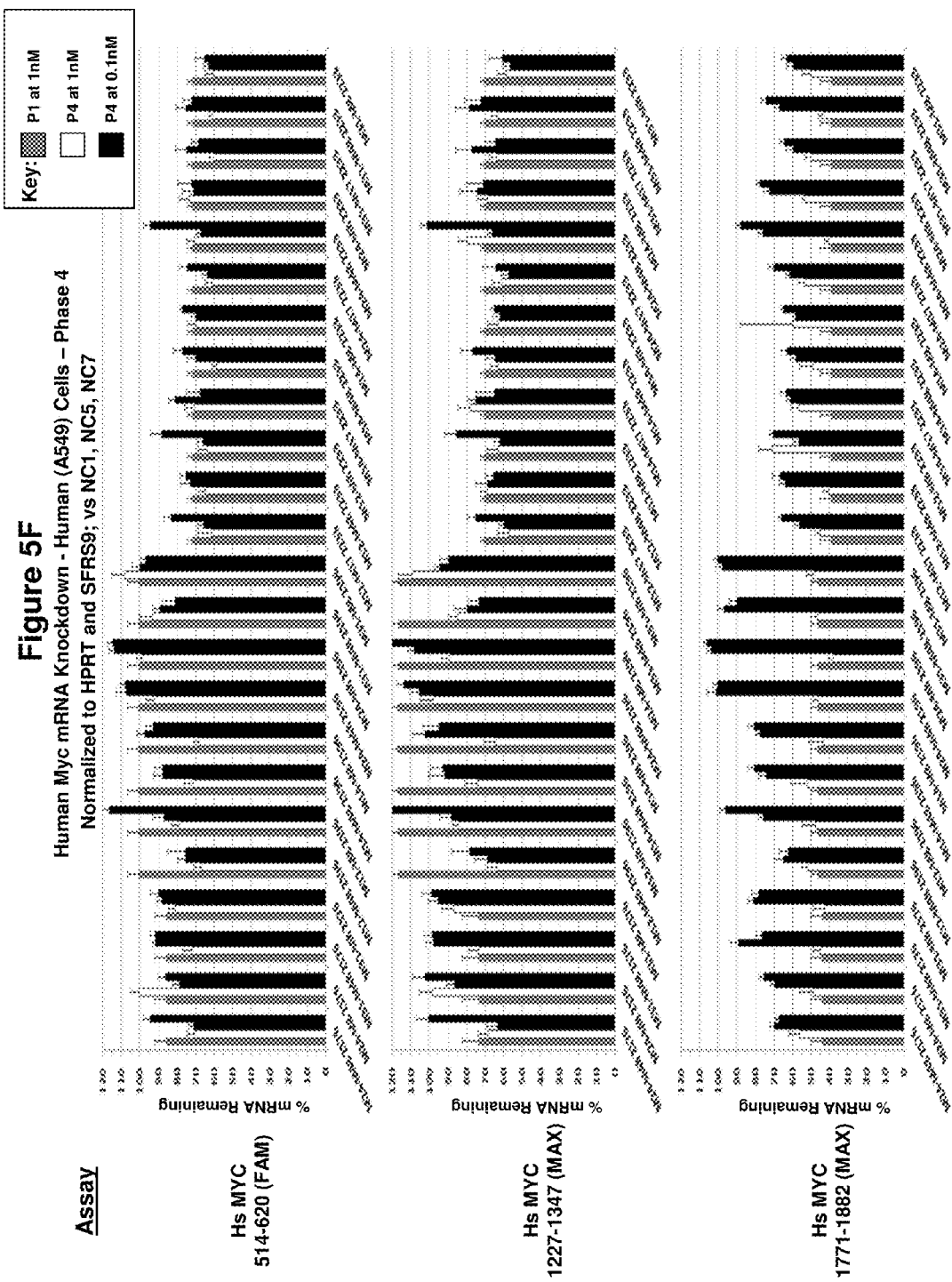

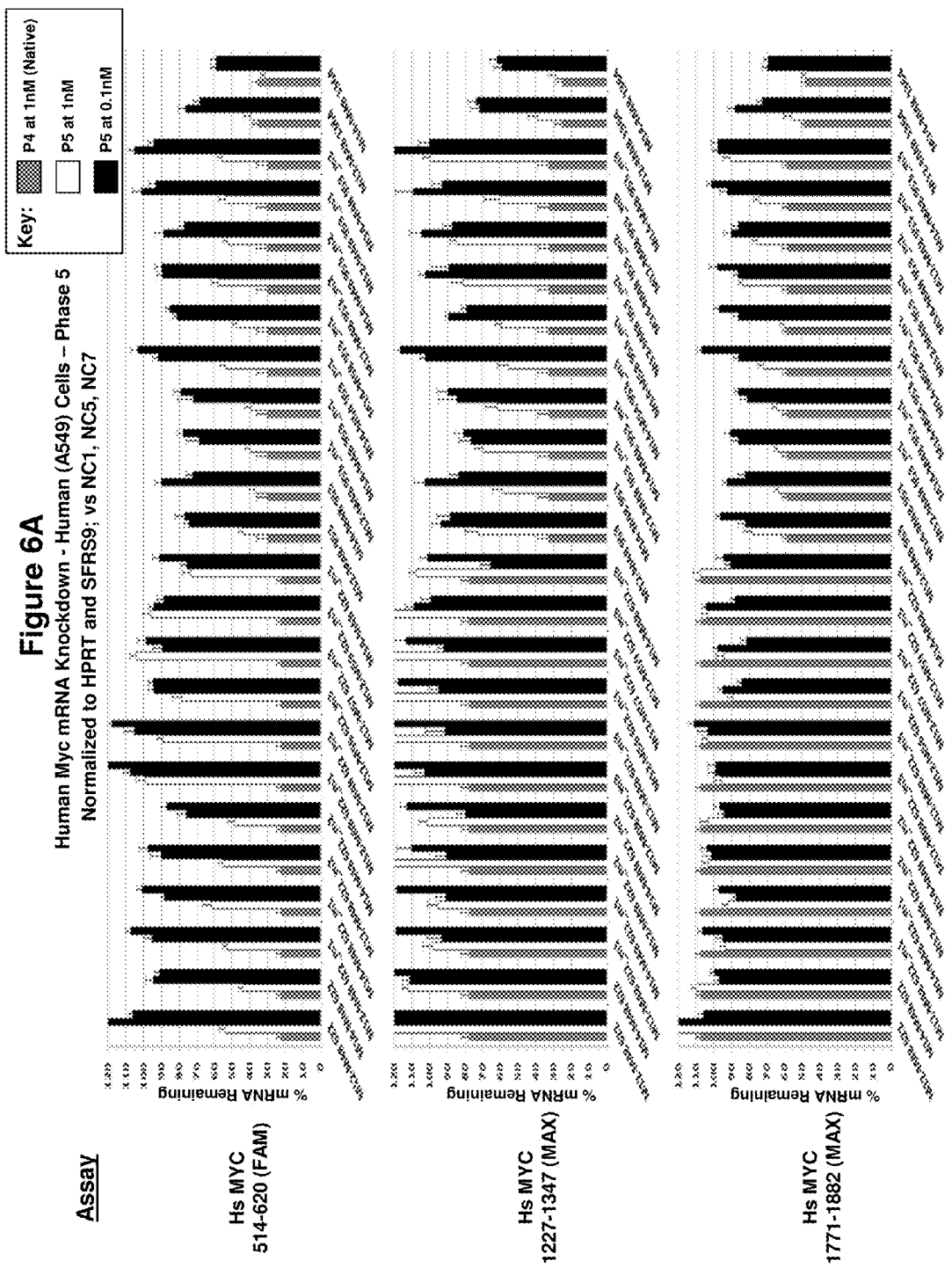

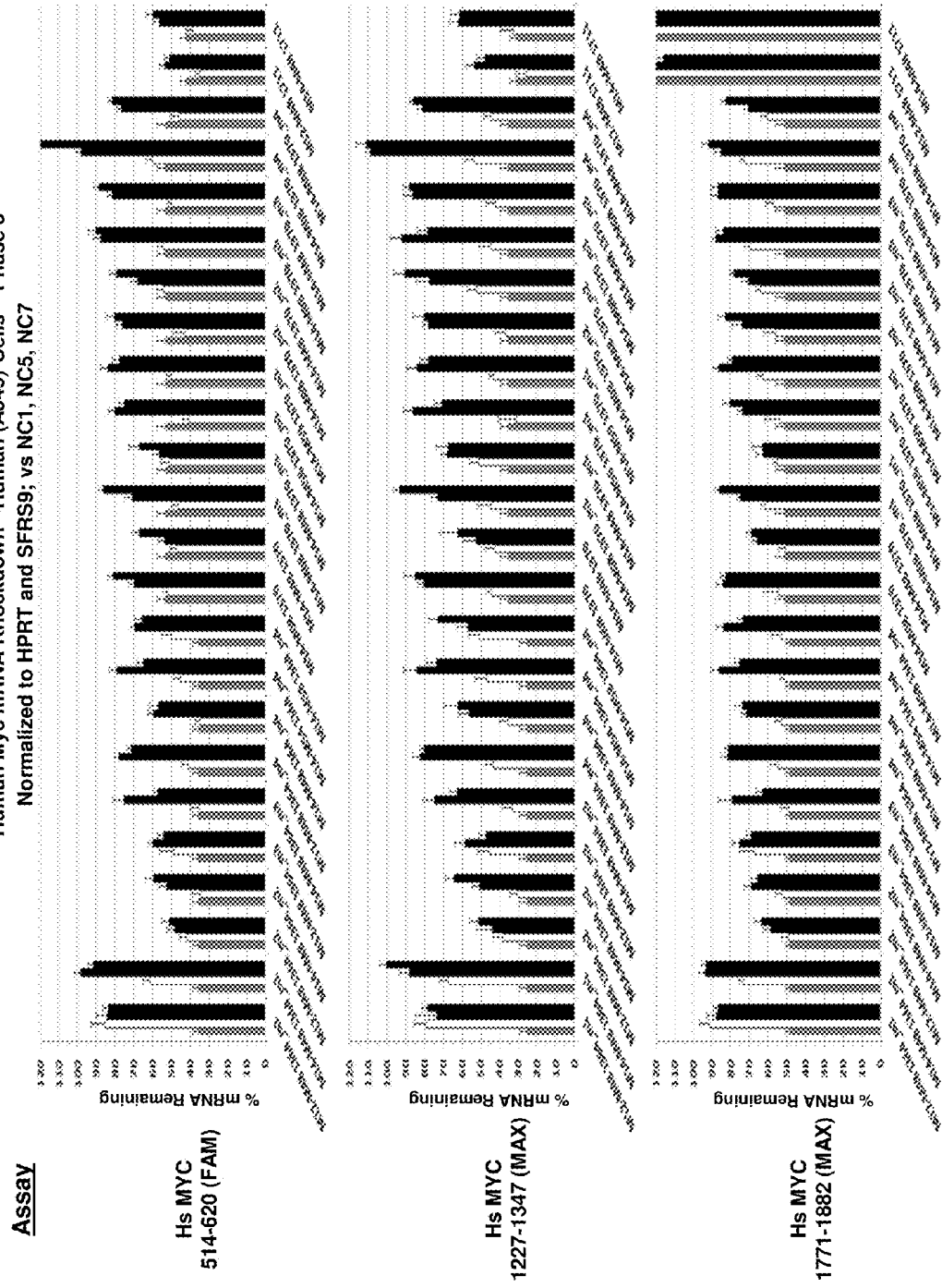

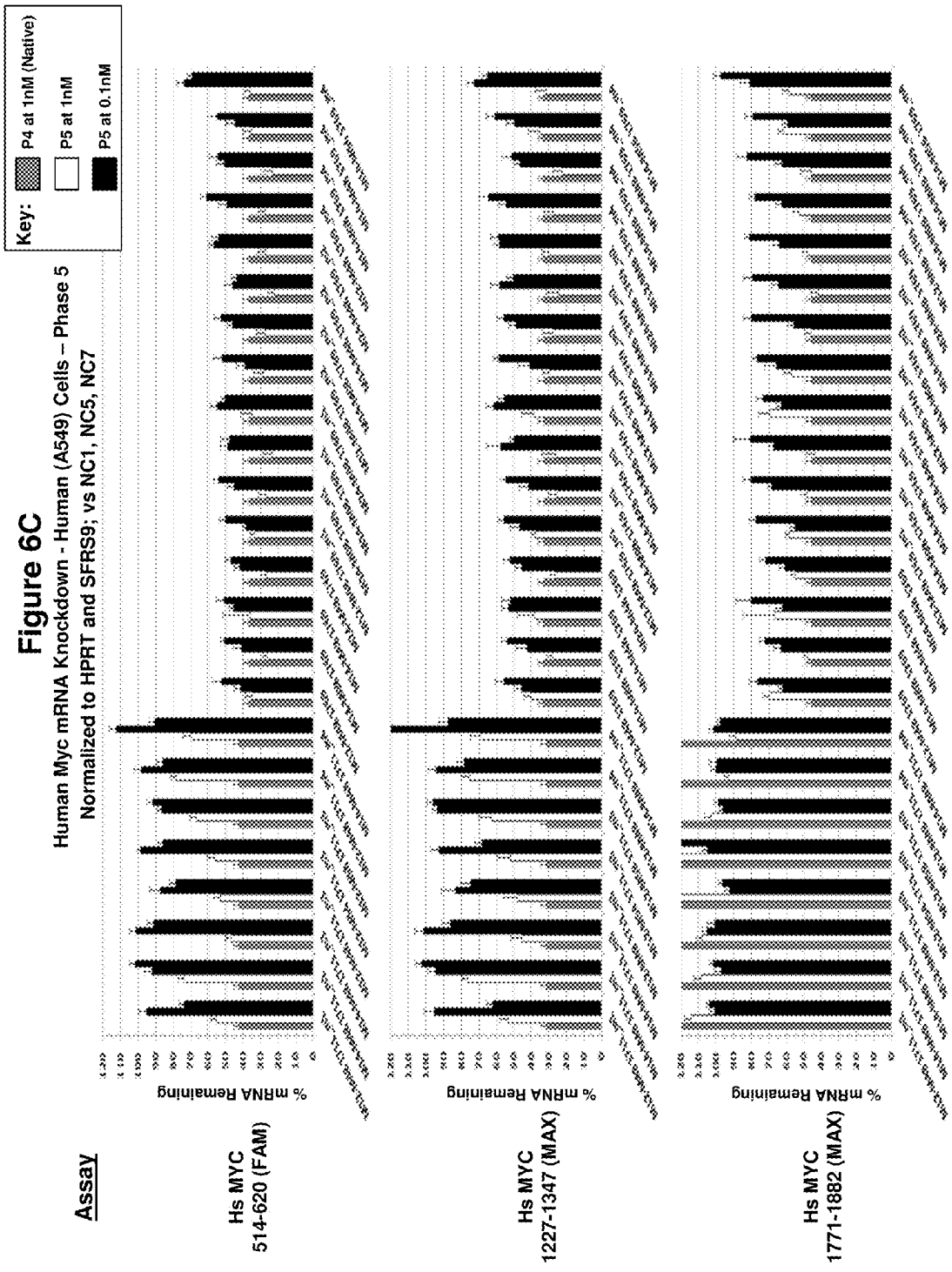

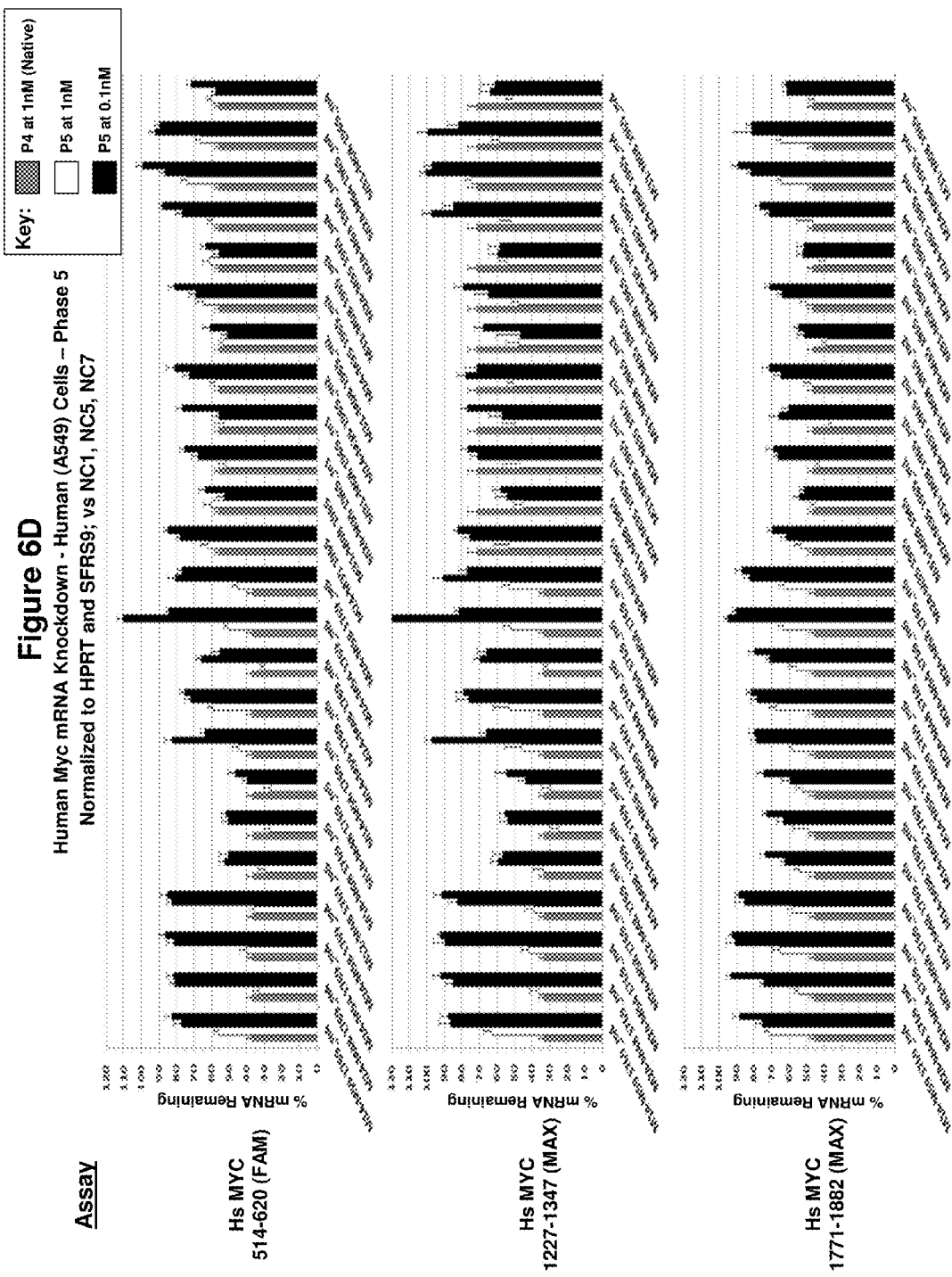

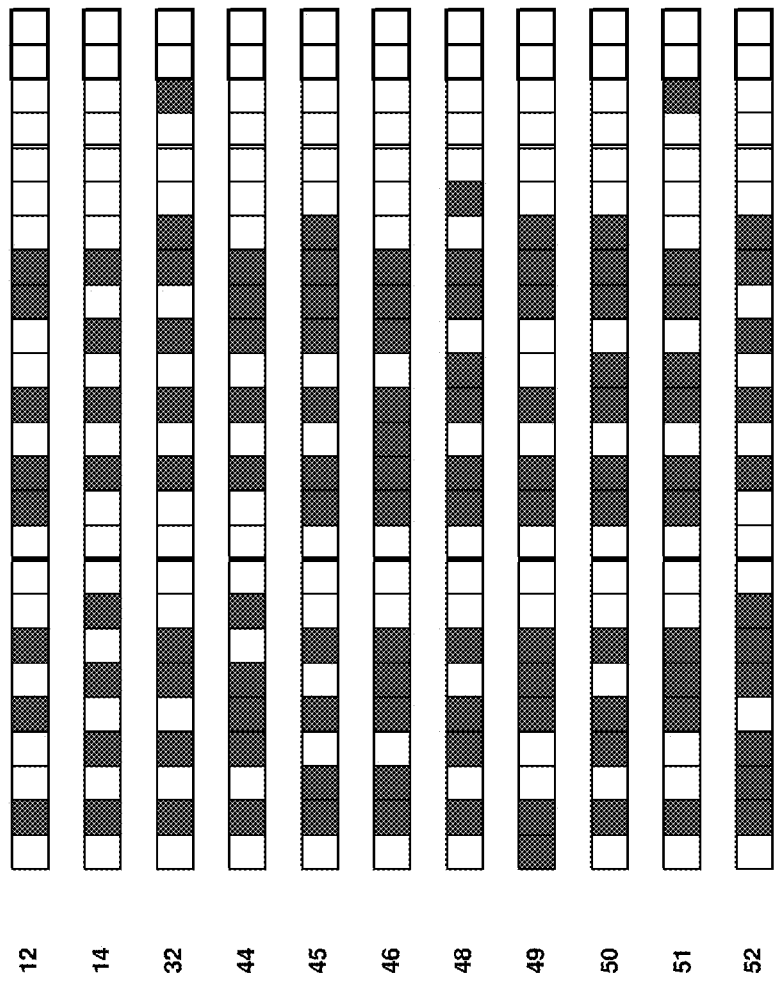

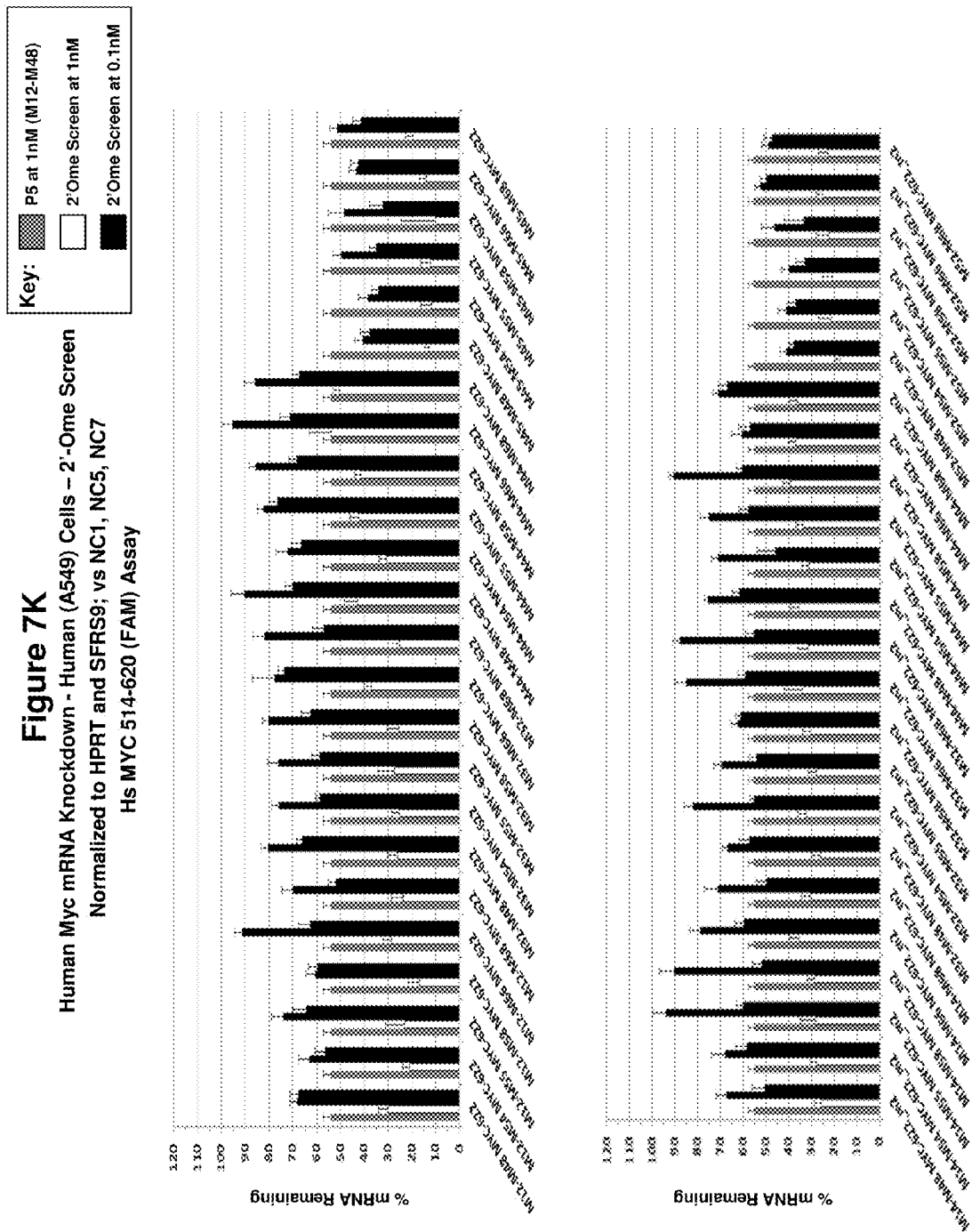

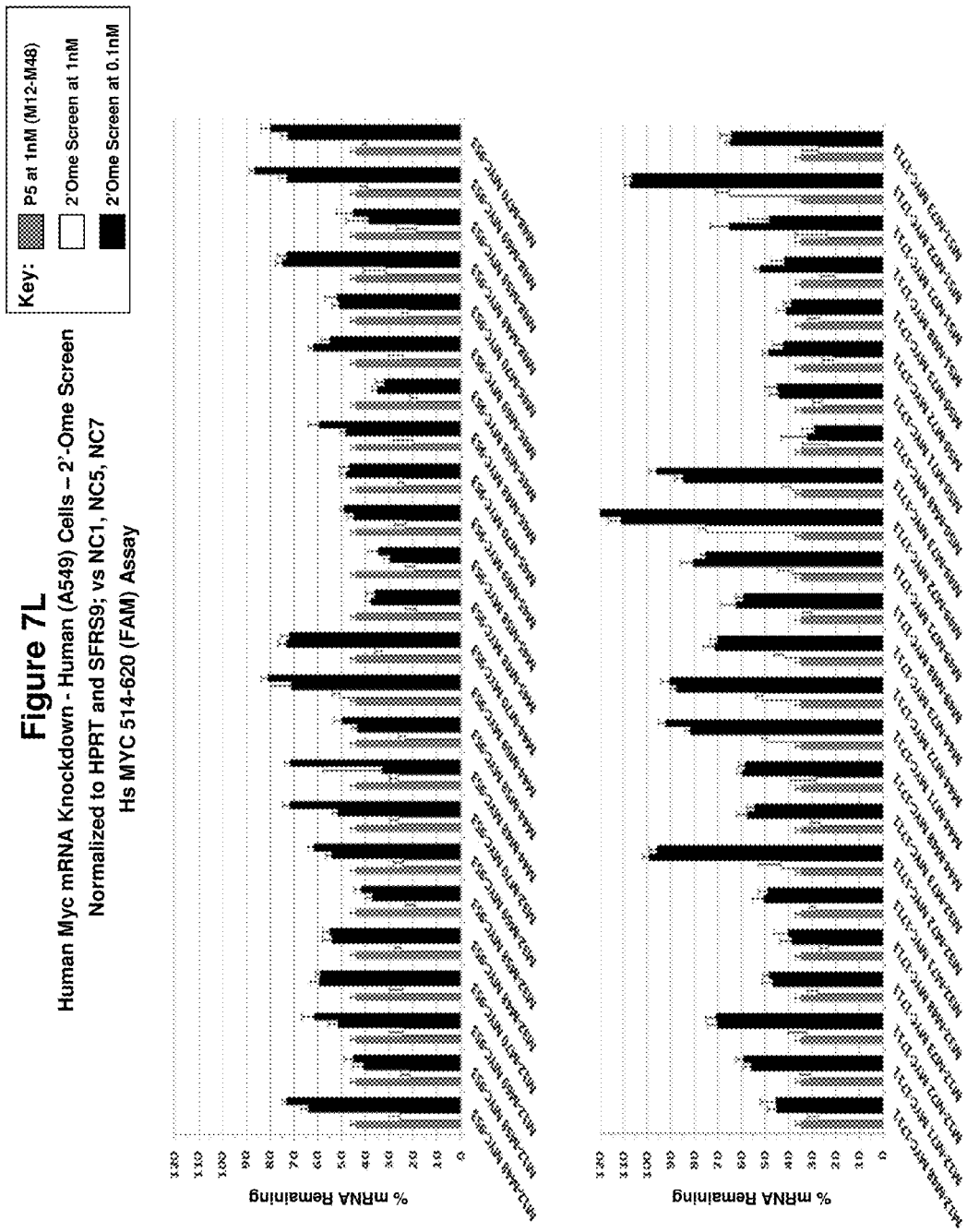

METHODS AND COMPOSITIONS FOR THE SPECIFIC INHIBITION OF MYC BY DOUBLE-STRANDED RNA

RELATED APPLICATIONS

The present application claims priority to, and the benefit under 35 U.S.C. §119(e) of the following applications: U.S. provisional patent application No. 61/701,136, entitled "Methods and Compositions for the Specific Inhibition of MYC by Double-Stranded RNA," filed Sep. 14, 2012; and U.S. provisional patent application No. 61/786,695, entitled "Methods and Compositions for the Specific Inhibition of MYC by Double-Stranded RNA," filed Mar. 15, 2013. The entire contents of the aforementioned patent applications are incorporated herein by this reference.

FIELD OF THE INVENTION

The present invention relates to compounds, compositions, and methods for the study, diagnosis, and treatment of traits, diseases and conditions that respond to the modulation of c-Myc gene expression and/or activity.

BACKGROUND OF THE INVENTION

The c-MYC (MYC) gene is a key molecular regulator of cellular growth and differentiation. Myc protein is a transcription factor that activates expression of many genes via binding of consensus sequences (Enhancer Box sequences (E-boxes)) and recruitment of histone acetyltransferases (HATs). Myc can also act as a transcriptional repressor. By binding Miz-1 transcription factor and displacing the p300 co-activator, Myc inhibits expression of Miz-1 target genes. In addition, Myc has a direct role in the control of DNA replication (Dominguez-Sola et al. Nature 448 (7152): 445-51).

Various mitogenic signaling pathways, including Wnt, Shh and EGF (via the MAPK/ERK pathway), have been demonstrated to activate Myc. Myc's role in modifying the expression of its target genes has been shown to cause numerous biological effects. The first to be discovered was its capability to drive cell proliferation (upregulates cyclins, downregulates p21), but Myc also plays a very important role in regulating cell growth (upregulates ribosomal RNA and proteins), apoptosis (downregulates Bcl-2), differentiation and stem cell self-renewal. Myc is a strong proto-oncogene and it its upregulation has been described in many types of cancers. Myc overexpression stimulates gene amplification (Denis et al. Oncogene 6 (8): 1453-7), via a mechanism believed to involve DNA over-replication.

At least because of the MYC oncogene's propensity to increase cell proliferation when specifically mutated or over-expressed, MYC is an attractive target for inhibitory onco-therapeutics, including small molecule and nucleic acid inhibitors of MYC.

Double-stranded RNA (dsRNA) agents possessing strand lengths of 25 to 35 nucleotides have been described as effective inhibitors of target gene expression in mammalian cells (Rossi et al., U.S. Patent Application Nos. 2005/0244858 and US 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220).

Provided herein are improved nucleic acid agents that target MYC. In particular, those targeting MYC have been specifically exemplified.

BRIEF SUMMARY OF THE INVENTION

The present invention is directed to nucleic acid compositions that reduce expression of MYC. Such compositions contain nucleic acids such as double stranded RNA ("dsRNA"), and methods for preparing them. The nucleic acids of the invention are capable of reducing the expression of a target MYC gene in a cell, either in vitro or in a mammalian subject.

In one aspect, the invention provides an isolated nucleic acid having an oligonucleotide strand of 15-35 nucleotides in length, where the oligonucleotide strand is sufficiently complementary to a target MYC mRNA sequence of Table 15 along at least 15 nucleotides of the oligonucleotide strand length to reduce MYC target mRNA expression when the nucleic acid is introduced into a mammalian cell.

Another aspect of the invention provides an isolated nucleic acid having an oligonucleotide strand of 19-35 nucleotides in length, where the oligonucleotide strand is sufficiently complementary to a target MYC mRNA sequence of Table 14 along at least 19 nucleotides of the oligonucleotide strand length to reduce MYC target mRNA expression when the nucleic acid is introduced into a mammalian cell.

An additional aspect of the invention provides an isolated double stranded nucleic acid (dsNA) having first and second nucleic acid strands possessing RNA, where the first strand is 15-35 nucleotides in length and the second strand of the dsNA is 19-35 nucleotides in length, where the second oligonucleotide strand is sufficiently complementary to a target MYC mRNA sequence of Table 15 along at least 15 nucleotides of the second oligonucleotide strand length to reduce MYC target mRNA expression when the double stranded nucleic acid is introduced into a mammalian cell.

A further aspect of the invention provides an isolated double stranded nucleic acid (dsNA) having first and second nucleic acid strands, where the first strand is 15-35 nucleotides in length and the second strand of the dsNA is 19-35 nucleotides in length, where the second oligonucleotide strand is sufficiently complementary to a target MYC mRNA sequence of Table 14 along at least 19 nucleotides of the second oligonucleotide strand length to reduce MYC target mRNA expression when the double stranded nucleic acid is introduced into a mammalian cell.

Another aspect of the invention provides an isolated double stranded nucleic acid (dsNA) having first and second nucleic acid strands, where the first strand is 15-35 nucleotides in length and the second strand of the dsNA is 19-35 nucleotides in length, where the second oligonucleotide strand is sufficiently complementary to a target MYC mRNA sequence of Table 13 along at least 19 nucleotides of the second oligonucleotide strand length to reduce MYC target mRNA expression, and wherein, starting from the 5' end of the MYC mRNA sequence of Table 13 (position 1), mammalian Ago2 cleaves the mRNA at a site between positions 9 and 10 of the sequence, when the double stranded nucleic acid is introduced into a mammalian cell.

An additional aspect of the invention provides an isolated dsNA molecule formed by: (a) a sense region and an antisense region, where the sense region and the antisense region together form a duplex region of 25-35 base pairs and the antisense region contains a sequence that is the complement of a sequence of Table 12; and (b) from zero to two 3' overhang regions, where each overhang region is six or fewer nucleotides in length.

A further aspect of the invention provides an isolated dsNA molecule formed by: (a) a sense region and an antisense region, where the sense region and the antisense region together form a duplex region of 25-35 base pairs and the antisense region contains a sequence that is the complement of a sequence of Table 12; and (b) from zero to two 3' overhang regions, wherein each overhang region is six or fewer nucleotides in length, and where, starting from the 5' end of the MYC mRNA sequence of Table 11 (position 1), mammalian Ago2 cleaves the mRNA at a site between positions 9 and 10 of the sequence, when the double stranded nucleic acid is introduced into a mammalian cell.

Another aspect of the invention provides an isolated double stranded nucleic acid (dsNA) having first and second nucleic acid strands and a duplex region of at least 25 base pairs, where the first strand is 25-34 nucleotides in length and the second strand of the dsNA is 26-35 nucleotides in length and possesses 1-5 single-stranded nucleotides at its 3' terminus, where the second oligonucleotide strand is sufficiently complementary to a target MYC mRNA sequence of Table 11 along at least 19 nucleotides of the second oligonucleotide strand length to reduce MYC target gene expression when the double stranded nucleic acid is introduced into a mammalian cell.

In another aspect, the invention provides an isolated double stranded nucleic acid (dsNA) having first and second nucleic acid strands and a duplex region of at least 25 base pairs, where the first strand is 25-34 nucleotides in length and the second strand of the dsNA is 26-35 nucleotides in length and possesses 1-5 single-stranded nucleotides at its 3' terminus, wherein the 3' terminus of the first oligonucleotide strand and the 5' terminus of the second oligonucleotide strand form a blunt end, and the second oligonucleotide strand is sufficiently complementary to a target MYC sequence of SEQ ID NOs: 1309-1635 and 1963-3270 along at least 19 nucleotides of the second oligonucleotide strand length to reduce MYC mRNA expression when the double stranded nucleic acid is introduced into a mammalian cell.

In one embodiment, the isolated dsNA has a duplex region of at least 25 base pairs, 19-21 base pairs or 21-25 base pairs. In another embodiment, the second oligonucleotide strand possesses 1-5 single-stranded nucleotides at its 3' terminus. In a further embodiment, the first strand is 25-35 nucleotides in length. In certain embodiments, the invention also provides for an isolated dsNA where the first strand is 26-35 nucleotides in length, 27-35 nucleotides in length, 28-35 nucleotides in length, 29-35 nucleotides in length, 30-35 nucleotides in length, 31-35 nucleotides in length, 33-35 nucleotides in length, 34-35 nucleotides in length, 17-35 nucleotides in length, 19-35 nucleotides in length, 21-35 nucleotides in length, 23-35 nucleotides in length, 17-33 nucleotides in length, 17-31 nucleotides in length, 17-29 nucleotides in length, 17-27 nucleotides in length, 21-35 nucleotides in length or 19-33 nucleotides in length.

In one embodiment, the second strand is 25-35 nucleotides in length. In certain embodiments, the invention also provides for an isolated dsNA where the second strand is 26-35 nucleotides in length, 27-35 nucleotides in length, 28-35 nucleotides in length, 29-35 nucleotides in length, 30-35 nucleotides in length, 31-35 nucleotides in length, 33-35 nucleotides in length, 34-35 nucleotides in length, 21-35 nucleotides in length, 23-35 nucleotides in length, 25-35 nucleotides in length, 27-35 nucleotides in length, 19-33 nucleotides in length, 19-31 nucleotides in length, 19-29 nucleotides in length, 19-27 nucleotides in length or 19-25 nucleotides in length.

In another embodiment, the second oligonucleotide strand is complementary to a target MYC cDNA sequence of GenBank Accession Nos. NM_002467.4 and NM_010849.4 along at most 27 nucleotides of the second oligonucleotide strand length.

In one embodiment, the dsNA includes a modified nucleotide. Optionally, the modified nucleotide residue is 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino or 2'-O—(N-methlycarbamate).

In certain embodiments, starting from the first nucleotide (position 1) at the 3' terminus of the first oligonucleotide strand, position 1, 2 and/or 3 is substituted with a modified nucleotide. Optionally, the modified nucleotide residue of the 3' terminus of the first strand is a deoxyribonucleotide, an acyclonucleotide or a fluorescent molecule. In certain embodiments, position 1 of the 3' terminus of the first oligonucleotide strand is a deoxyribonucleotide In one embodiment, the 3' terminus of the first strand and the 5' terminus of the second strand form a blunt end.

In another embodiment, the first strand is 25 nucleotides in length and the second strand is 27 nucleotides in length. In a further embodiment, starting from the 5' end of a MYC mRNA sequence of Table 10 (position 1), mammalian Ago2 cleaves the mRNA at a site between positions 9 and 10 of the sequence, thereby reducing MYC target mRNA expression when the double stranded nucleic acid is introduced into a mammalian cell. In certain embodiments, starting from the 5' end of a MYC mRNA sequence of SEQ ID NOs: 1309-1635 or 1963-2289, mammalian Ago2 cleaves the mRNA at a site between positions 9 and 10 of the mRNA sequence, thereby reducing MYC target mRNA expression when the double stranded nucleic acid is introduced into a mammalian cell.

In one embodiment, the second strand includes a sequence of SEQ ID NOs: 328-654.

In another embodiment, the first strand includes a sequence of SEQ ID NOs: 1-327, 982-1308 and 1636-1962.

In certain embodiments, a dsNA of the invention includes a pair of first strand/second strand sequences of Table 2.

In some embodiments, each of the first and the second strands has a length which is at least 26 nucleotides. The invention also provides for an isolated dsNA where each of the first and the second strands has a length which is at least 27 nucleotides, at least 28 nucleotides, at least 29 nucleotides, at least 30 nucleotides, at least 31 nucleotides, at least 32 nucleotides, at least 33 nucleotides, at least 34 nucleotides or at least 35 nucleotides.

In certain embodiments, the nucleotides of the 1-5 single-stranded nucleotides of the 3' terminus of the second strand include a modified nucleotide. Optionally, the modified nucleotide of the 1-5 single-stranded nucleotides of the 3' terminus of the second strand is a 2'-O-methyl ribonucleotide. In some embodiments, all nucleotides of the 1-5 single-stranded nucleotides of the 3' terminus of the second strand are modified nucleotides. In one embodiment, the 1-5 single-stranded nucleotides of the 3' terminus of the second strand are 1-3 or, optionally, 1-2 nucleotides in length. In certain embodiments, the 1-5 single-stranded nucleotides of the 3' terminus of the second strand is two nucleotides in length and includes a 2'-O-methyl modified ribonucleotide.

In one embodiment, the second oligonucleotide strand possesses a modification pattern of AS-M1 to AS-M46 and AS- M1* to AS-M46*. In another embodiment, the first oligonucleotide strand possesses a modification pattern of SM1 to SM22.

In another embodiment, each of the first and the second strands has a length which is at least 26 and at most 30 nucleotides. The invention also provides for an isolated dsNA, wherein either or each of the first and the second strands has a length which is at least 27 and at most 30 nucleotides, at least 28 and at most 30 nucleotides and at least 29 or at most 30 nucleotides.

In certain embodiments, the dsNA is cleaved endogenously in a cell by Dicer.

In some embodiments, the amount of the isolated nucleic acid sufficient to reduce expression of the target gene is 1 nanomolar or less, 200 picomolar or less, 100 picomolar or less, 50 picomolar or less, 20 picomolar or less, 10 picomolar or less, 5 picomolar or less, 2, picomolar or less or 1 picomolar or less in the environment of the cell.

In one embodiment, an isolated dsNA of the invention possesses greater potency than an isolated 21mer siRNA directed to the identical at least 19 nucleotides of the target MYC mRNA in reducing target MYC mRNA expression when assayed in vitro in a mammalian cell at an effective concentration in the environment of a cell of 1 nanomolar or less.

In another embodiment, an isolated dsNA of the invention is sufficiently complementary to the target MYC mRNA sequence to reduce MYC target mRNA expression by an amount (expressed by %) of at least 10%, at least 50%, at least 80-90%, at least 95%, at least 98%, or at least 99% when the double stranded nucleic acid is introduced into a mammalian cell. In related embodiments, the invention provides for an isolated dsNA that is sufficiently complementary to a target MYC mRNA sequence along at least 15, 16, 17, 18, 19, 20, 21, 22, 23, 24, 25 or more nucleotides of the second oligonucleotide strand length to reduce MYC target mRNA expression when the dsNA is introduced into a mammalian cell.

In one embodiment, the first and second strands of a dsNA of the invention are joined by a chemical linker. Optionally, the 3' terminus of the first strand and the 5' terminus of the second strand are joined by a chemical linker.

In certain embodiments, a nucleotide of the second or first strand is substituted with a modified nucleotide that directs the orientation of Dicer cleavage.

In some embodiments, an isolated nucleic acid of the invention possesses a modified nucleotide that is a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, or a locked nucleic acid.

In one embodiment, a dsNA of the invention possesses a phosphate backbone modification that is a phosphonate, a phosphorothioate or a phosphotriester.

Optionally, a dsNA of the invention possesses a modification that is a morpholino nucleic acid or a peptide nucleic acid (PNA).

Another aspect of the invention provides a method for reducing expression of a target MYC gene in a mammalian cell involving contacting a mammalian cell in vitro with an isolated dsNA of the invention in an amount sufficient to reduce expression of a target MYC mRNA in the cell.

In one embodiment, MYC mRNA levels are reduced by an amount (expressed by %) of at least 90% at least 8 days after the cell is contacted with the dsNA. In another embodiment, MYC mRNA levels are reduced by an amount (expressed by %) of at least 70% at least 10 days after the cell is contacted with the dsNA.

A further aspect of the invention provides a method for reducing expression of a target MYC mRNA in a mammal involving administering an isolated nucleic acid of the invention in an amount sufficient to reduce expression of a target MYC mRNA in the mammal.

Another aspect of the invention provides a method for reducing tumor burden in a mammal involving administering an isolated nucleic acid of the invention to a mammal in an amount sufficient to reduce tumor burden in the mammal.

In one embodiment, the tumor is a hepatocellular carcinoma. In another embodiment, the tumor burden is reduced by 50-80%, as compared to a suitable control.

In certain embodiments, the isolated nucleic acid is formulated in a lipid nanoparticle (LNP).

In some embodiments, the isolated nucleic acid is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In certain embodiments, the isolated nucleic acid of the invention possesses greater potency than isolated 21mer siRNAs directed to the identical at least 19 nucleotides of the target MYC mRNA in reducing target MYC mRNA expression when assayed in vitro in a mammalian cell at an effective concentration in the environment of a cell of 1 nanomolar or less.

In one embodiment, MYC mRNA levels are reduced in a tissue of the mammal by an amount (expressed by %) of at least 70% at least 3 days after the isolated dsNA is administered to the mammal. Optionally, the tissue is liver tissue.

In some embodiments, the administering step involves intravenous injection, intramuscular injection, intraperitoneal injection, infusion, subcutaneous injection, transdermal, aerosol, rectal, vaginal, topical, oral or inhaled delivery.

A further aspect of the invention provides a method for selectively inhibiting the growth of a cell that involves contacting a cell with an amount of an isolated nucleic acid of the invention sufficient to inhibit the growth of the cell.

In one embodiment, the cell is a tumor cell of a subject. Optionally, the cell is a tumor cell in vitro. In a related embodiment, the cell is a human cell.

Another aspect of the invention provides a formulation that includes the isolated nucleic acid of the invention, where the nucleic acid is present in an amount effective to reduce target MYC mRNA levels when the nucleic acid is introduced into a mammalian cell in vitro by an amount (expressed by %) of at least 10%, at least 50% or at least 80-90%.

In one embodiment, the effective amount is 1 nanomolar or less, 200 picomolar or less, 100 picomolar or less, 50 picomolar or less, 20 picomolar or less, 10 picomolar or less, 5 picomolar or less, 2, picomolar or less or 1 picomolar or less in the environment of the cell.

An additional aspect of the invention provides a formulation containing the isolated dsNA of the invention, where the dsNA is present in an amount effective to reduce target MYC mRNA levels when the dsNA is introduced into a cell of a mammalian subject by an amount (expressed by %) of the group consisting of at least 10%, at least 50% and at least 80-90%.

In one embodiment, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

Another aspect of the invention provides a mammalian cell containing an isolated nucleic acid of the invention.

A further aspect of the invention provides a pharmaceutical composition containing the isolated nucleic acid of the invention and a pharmaceutically acceptable carrier.

An additional aspect of the invention provides a kit that includes the isolated nucleic acid of the invention and instructions for its use.

In another aspect, the invention provides a method for treating or preventing a MYC-associated disease or disorder in a subject that involves administering an isolated nucleic acid of the invention and a pharmaceutically acceptable carrier to the subject in an amount sufficient to treat or prevent the MYC-associated disease or disorder in the subject, thereby treating or preventing the MYC-associated disease or disorder in the subject.

In one embodiment, the MYC-associated disease or disorder is liver, renal, breast, lung, ovarian, cervical, esophageal, oropharyngeal or pancreatic cancer. Optionally, the MYC-associated disease or disorder is hepatocellular carcinoma.

Another aspect of the invention provides a composition possessing MYC inhibitory activity consisting essentially of an isolated nucleic acid of the invention.

The present invention is also directed to compounds, compositions, and methods relating to traits, diseases and conditions that respond to the modulation of expression and/or activity of genes involved in MYC gene expression pathways or other cellular processes that mediate the maintenance or development of such traits, diseases and conditions. In certain aspects, the invention relates to small nucleic acid molecules that are capable of being processed by the Dicer enzyme, such as Dicer substrate siRNAs (DsiRNAs) capable of mediating RNA interference (RNAi) against MYC gene expression. The anti-MYC dsRNAs of the invention are useful, for example, in providing compositions for treatment of traits, diseases and conditions that can respond to modulation of MYC in a subject, such as cancer and/or other proliferative diseases, disorders, or conditions. Efficacy, potency, toxicity and other effects of an anti-MYC dsRNA can be examined in one or more animal models of proliferative disease (exemplary animal models of proliferative disease are recited below).

BRIEF DESCRIPTION OF THE DRAWINGS

FIGS. 2A to 2H present primary screen data showing DsiRNA-mediated knockdown of human MYC (FIGS. 2A to 2D) and mouse MYC (FIGS. 2E to 2H) in human and mouse cells, respectively. For each DsiRNA tested, three independent qPCR amplicons were assayed (in human cells, amplicons "514-620", "1227-1347" and "1771-1872" were assayed, while in mouse cells, amplicons "539-663", "1339-1428" and "1971-2062" were assayed).

FIGS. 3A to 3H show histograms of human and mouse MYC inhibitory efficacies observed for indicated DsiRNAs. "P1" indicates phase 1 (primary screen), while "P2" indicates phase 2. In phase 1, DsiRNAs were tested at 1 nM in the environment of A549 cells (human cell assays; FIGS. 3A to 3D) or mouse cells (Hepa 1-6 cell assays; FIGS. 3E to 3H). In phase 2, DsiRNAs were tested at 1 nM and at 0.1 nM (duplicate assays) in the environment of A549 cells. Individual bars represent average human (FIGS. 3A to 3D) or mouse (FIGS. 3E to 3H) MYC levels observed in triplicate, with standard errors shown. Human MYC levels were normalized to HPRT and SFRS9 levels, while mouse MYC levels were normalized to HPRT and Rp123 levels.

FIGS. 4A to 4H present histograms showing efficacy data for 24 independent MYC-targeting DsiRNA sequences across four different guide (antisense) strand 2'-O-methyl modification patterns ("M17", "M35", "M48" and "M8", respectively, as shown in FIGS. 4A to 4H, noting that modification patterns are recited as passenger strand modification pattern (here, "M0", or unmodified)-guide strand modification pattern, e.g., "M0-M17", "M0-M35", "M0-M48" or "M0-M8") in human A549 cells (FIGS. 4A to 4D) and mouse Hepa 1-6 cells (FIGS. 4E to 4H) at 0.1 nM (duplicate assays) and 1 nM.

FIGS. 5A to 5F present histograms showing efficacy data for 19 independent MYC-targeting DsiRNA sequences across varying passenger (sense) and guide (antisense) strand 2'-O-methyl modification patterns (modification patterns are recited as passenger strand modification pattern-guide strand modification pattern) in human A549 cells at 0.1 nM (duplicate assays) and 1 nM, with comparison to phase I (unmodified) levels of inhibition at 1 nM also shown.

FIGS. 6A to 6D show histograms demonstrating efficacy data for seven independent MYC-targeting DsiRNA sequences that incorporate mismatches with respect to the MYC mRNA target sequence, in human A549 cells at 0.1 nM (duplicate assays) and 1 nM, with comparison to phase 4 results (obtained with the native sequence only, which does not include any mismatches) at 1 nM also shown.

FIGS. 7A to 7L present an additional 2'-O-methyl modification screen performed upon MYC-622, MYC-953 and MYC-1711 duplexes. FIGS. 7A to 7H show schematic depictions of duplex modifications used in such assays, while FIGS. 7I and 7J present schematic depictions of individual sense strand and antisense strand 2'-O-methyl modification patterns, respectively. FIGS. 7K and 7L display histograms showing efficacy data for these MYC-targeting DsiRNA sequences across the varying passenger (sense) and guide (antisense) strand 2'-O-methyl modification patterns (modification patterns are recited as passenger strand modification pattern-guide strand modification pattern) in human A549 cells at 0.1 nM (duplicate assays) and 1 nM, with comparison to phase 5 (possessing a M12-M48 modification) levels of inhibition at 1 nM also shown.

DETAILED DESCRIPTION OF THE INVENTION

Figure 1:
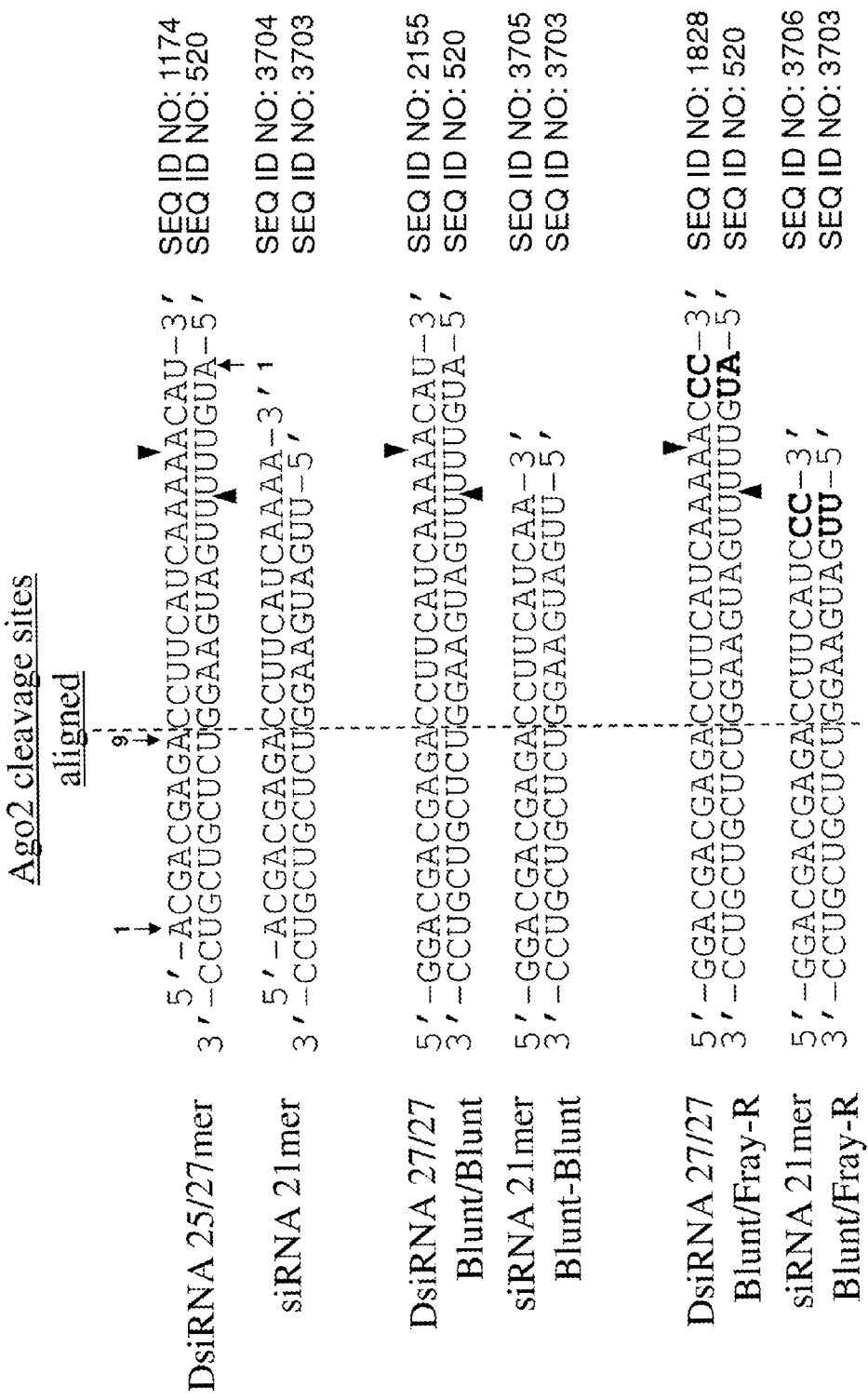
FIG. 1 shows the structures of exemplary DsiRNA agents of the invention targeting a site in the MYC RNA referred to herein as the "MYC-953" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted MYC sequence.
Figure 2B:
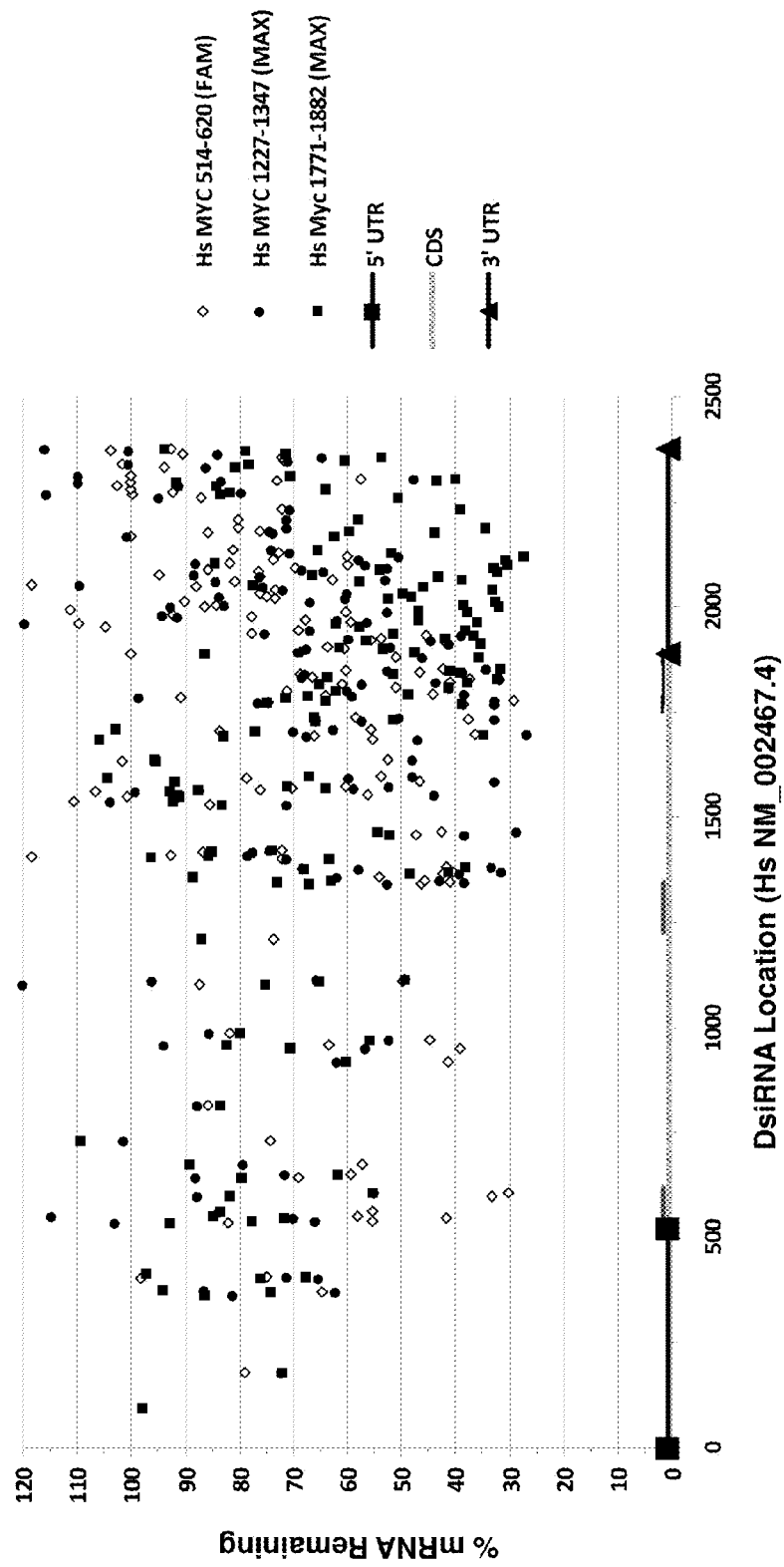
Figure 2E:
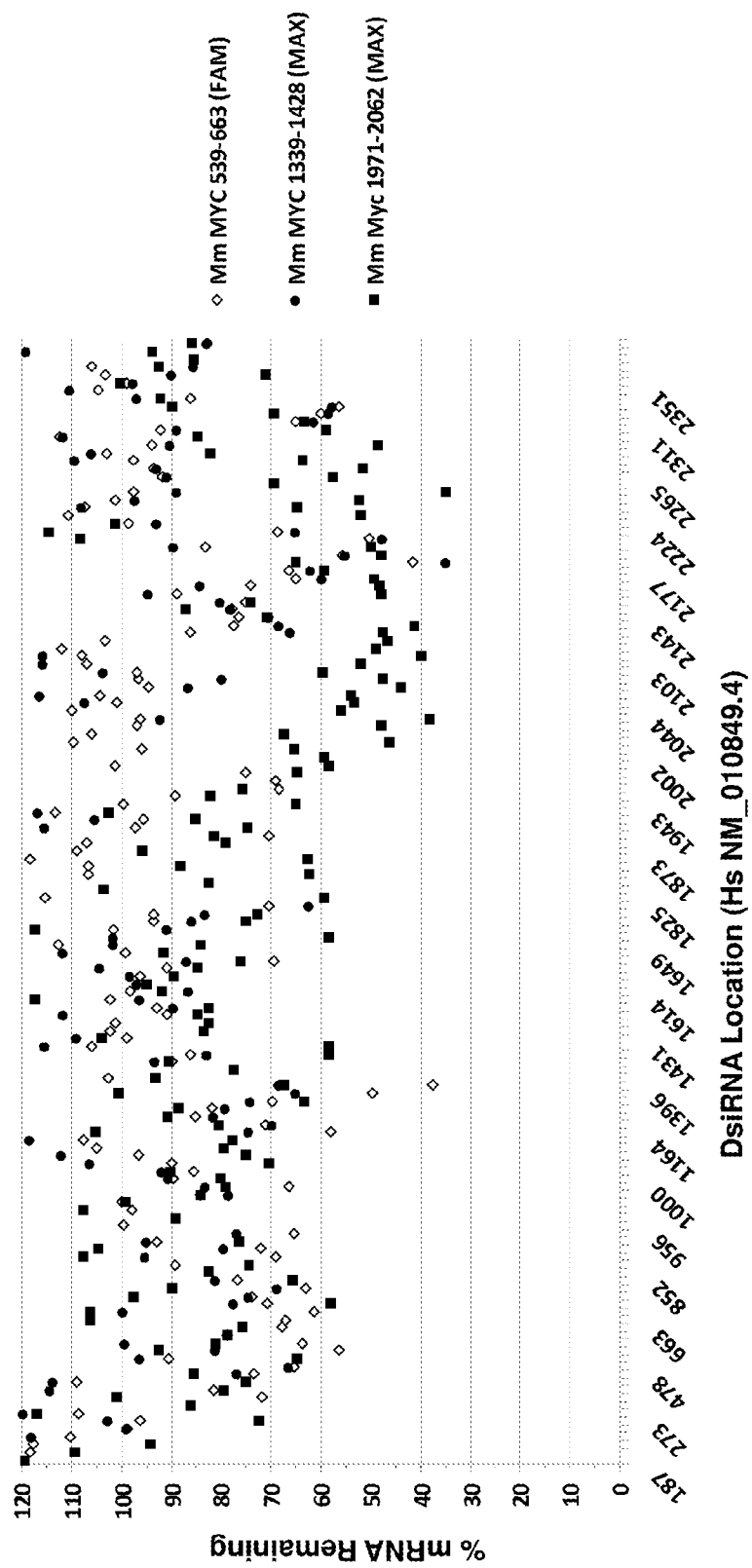
Figure 2F:
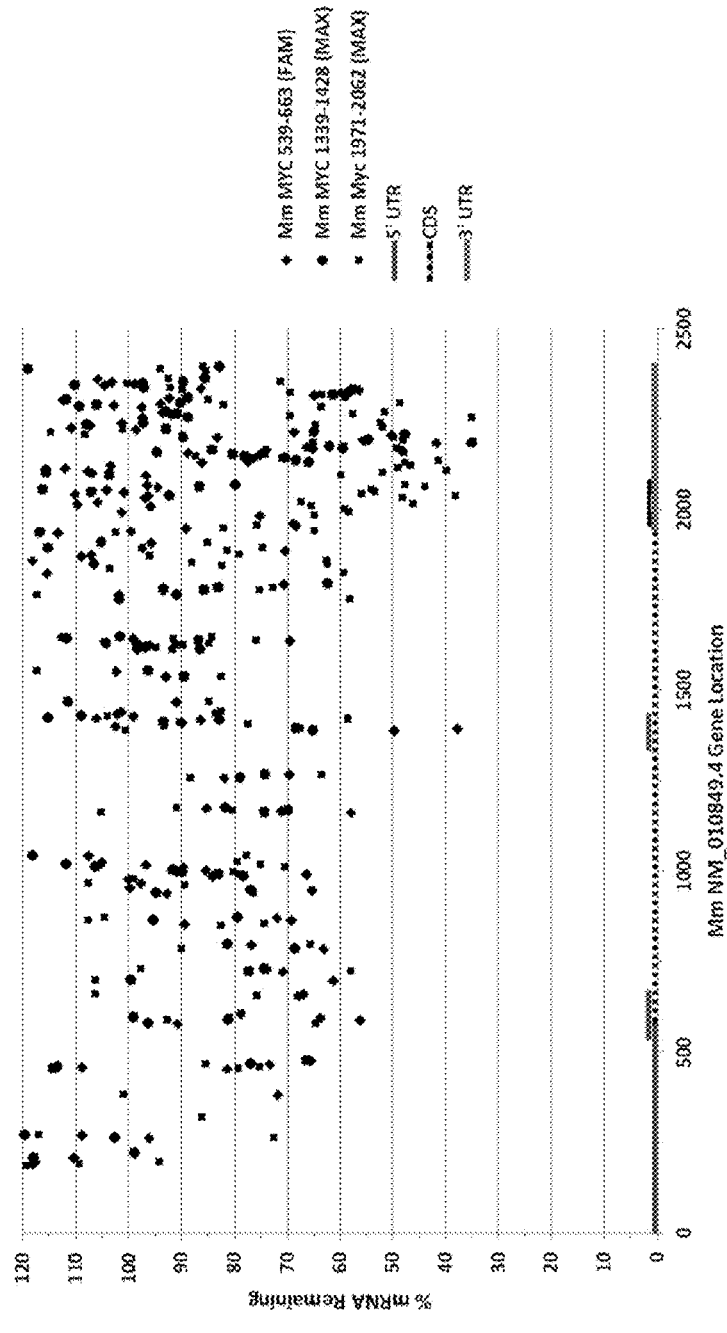
Figure 2G:
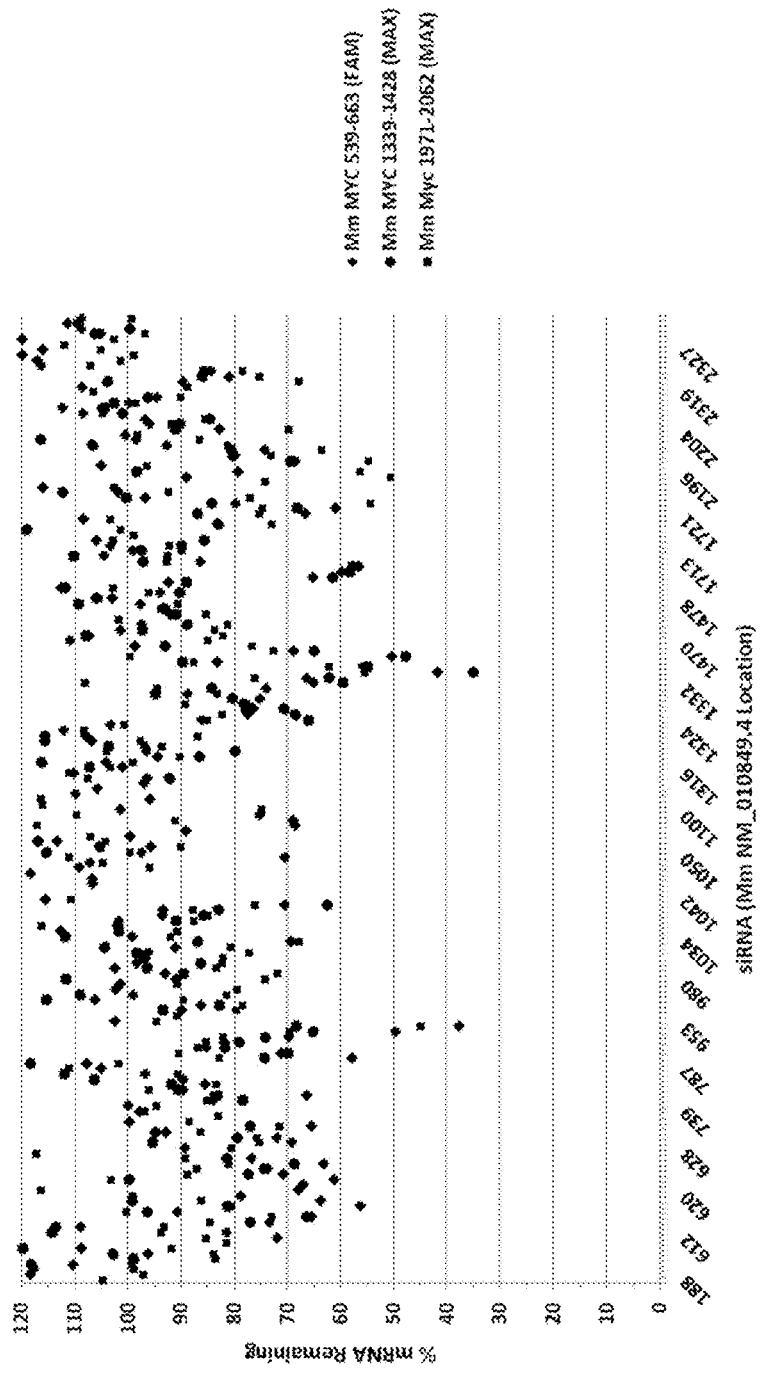
Figure 2H:
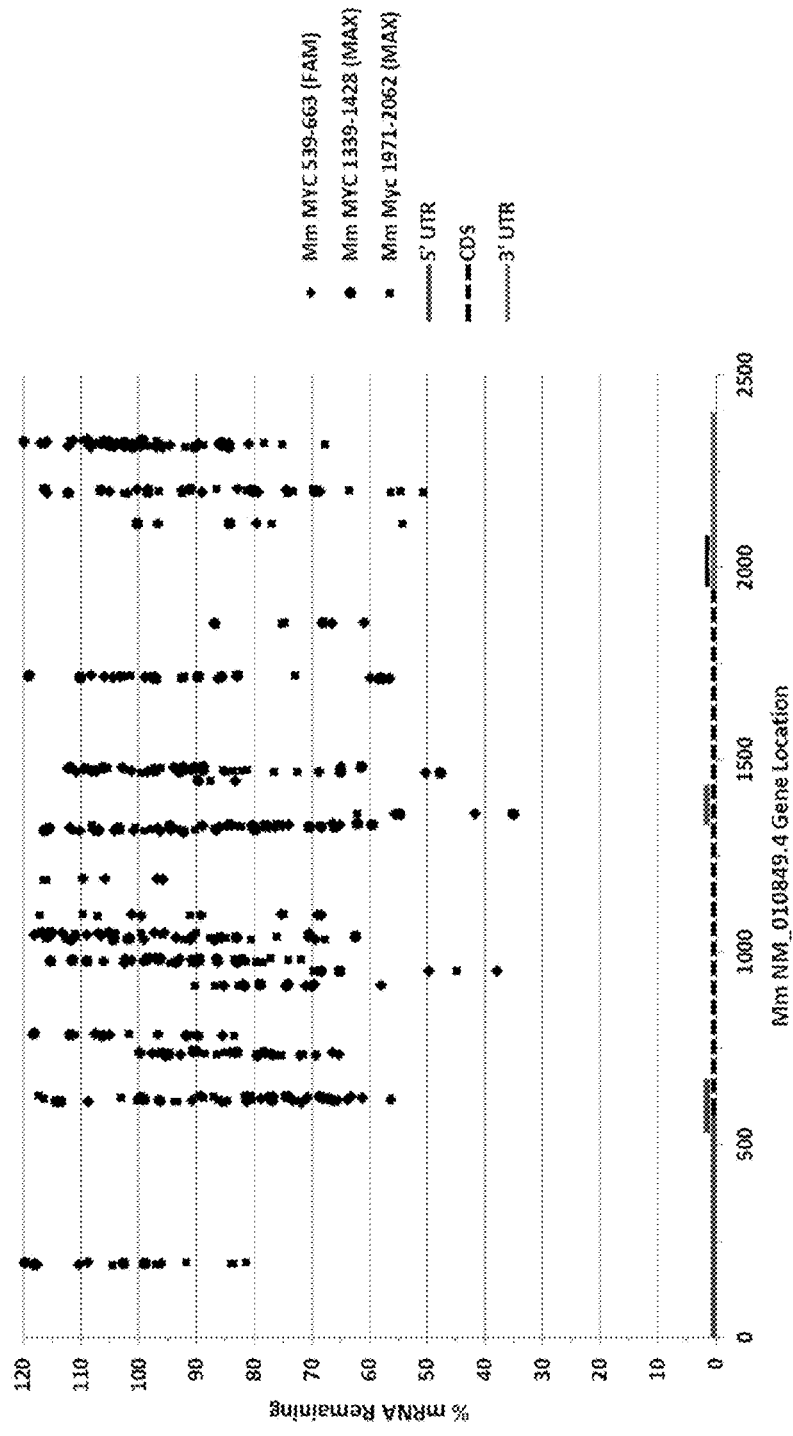
Figure 3A:
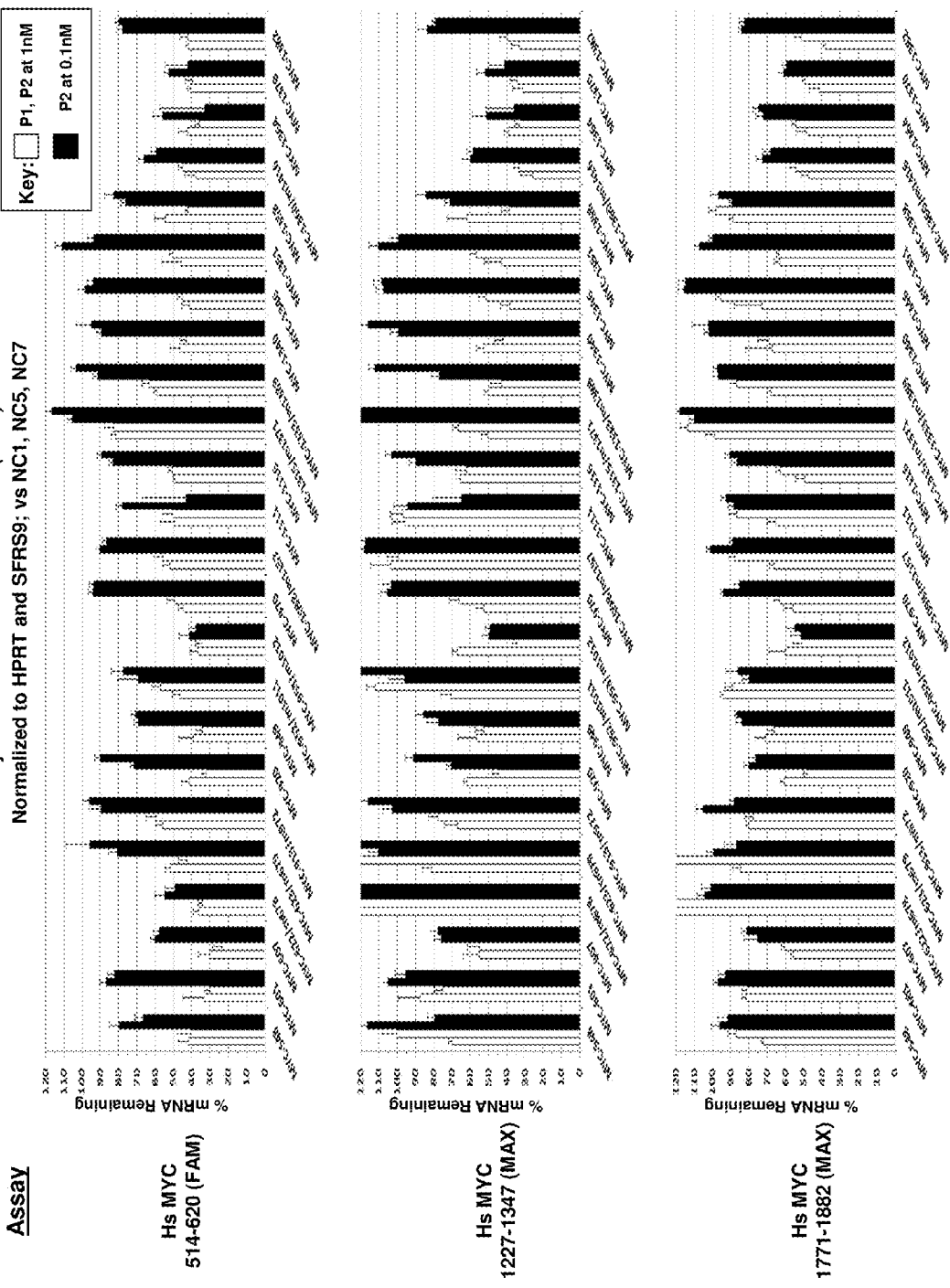
Figure 4A:
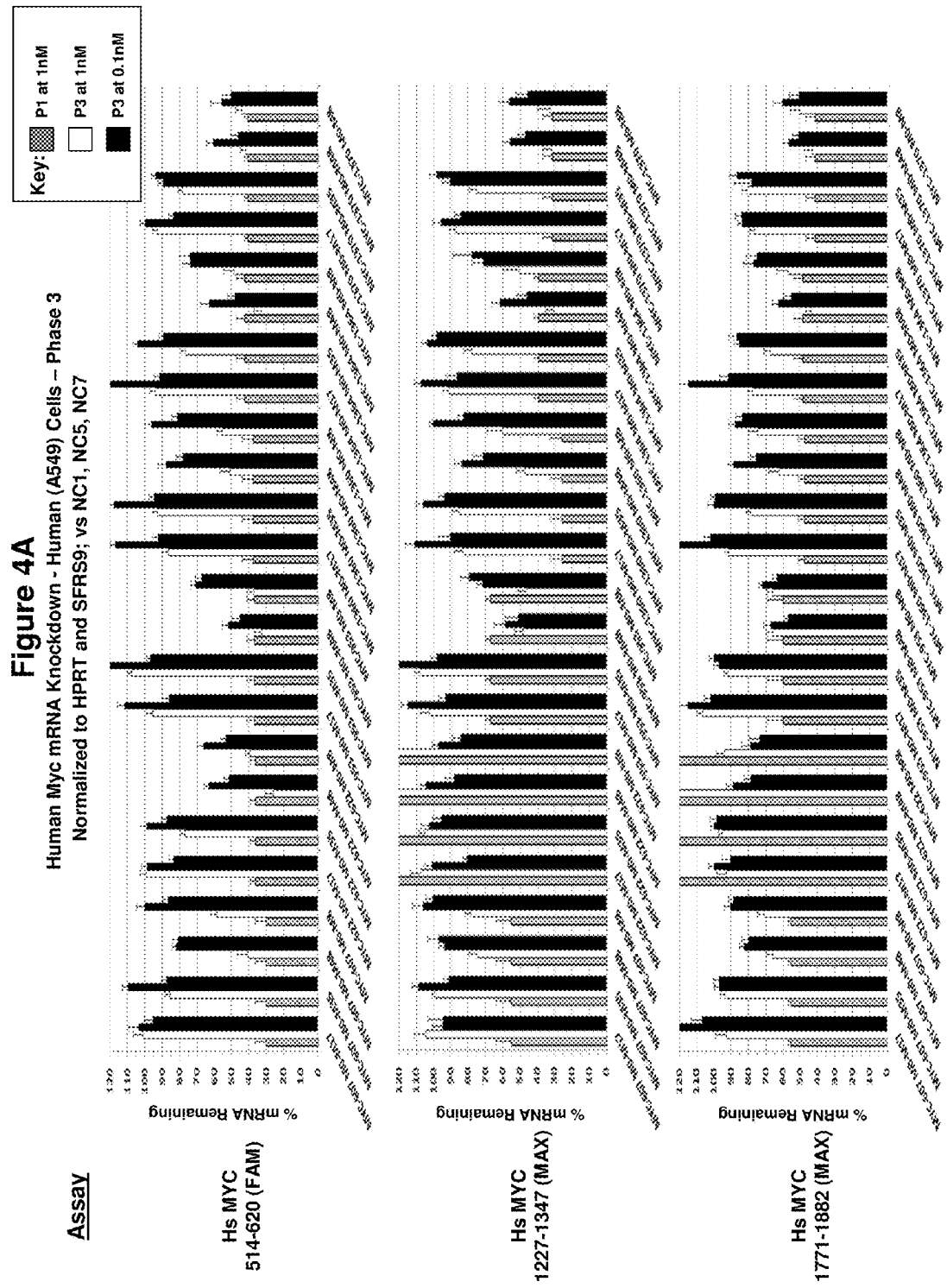

The present invention is directed to compositions that contain nucleic acids, for example double stranded RNA ("dsRNA"), and methods for preparing them, that are capable of reducing the level and/or expression of the MYC gene in vivo or in vitro. One of the strands of the dsRNA contains a region of nucleotide sequence that has a length that ranges from 19 to 35 nucleotides that can direct the destruction and/or translational inhibition of the targeted MYC transcript.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) MYC expression. The DsiRNAs of the invention optionally can be used in combination with modulators of other genes and/or gene products associated with the maintenance or development of diseases or disorders associated with MYC misregulation (e.g., tumor formation and/or growth, etc.). The DsiRNA agents of the invention modulate MYC RNAs such as those corresponding to the cDNA sequences referred to by GenBank Accession Nos. NM_002467.4 (human MYC) and NM_010849.4 (mouse MYC, transcript variant 1), which are referred to herein generally as "MYC."

The below description of the various aspects and embodiments of the invention is provided with reference to exemplary MYC RNAs, generally referred to herein as MYC. However, such reference is meant to be exemplary only and the various aspects and embodiments of the invention are also directed to alternate MYC RNAs, such as mutant MYC RNAs or additional MYC splice variants. Certain aspects and embodiments are also directed to other genes involved in MYC pathways, including genes whose misregulation acts in association with that of MYC (or is affected or affects MYC regulation) to produce phenotypic effects that may be targeted for treatment (e.g., tumor formation and/or growth, etc.). BAK1, Noxa, BCL2L11, Bcl-2-associated death promoter, PCNA, DAD1, TNKS and BH3 interacting domain death agonist are examples of genes that interact with MYC. Such additional genes, including those of pathways that act in coordination with MYC, can be targeted using dsRNA and the methods described herein for use of MYC-targeting dsRNAs. Thus, the inhibition and the effects of such inhibition of the other genes can be performed as described herein.

The term "MYC" refers to nucleic acid sequences encoding a Myc protein, peptide, or polypeptide (e.g., MYC transcripts, such as the sequences of MYC Genbank Accession Nos. NM_002467.4 and NM_010849.4). In certain embodiments, the term "MYC" is also meant to include other MYC encoding sequence, such as other MYC isoforms, mutant MYC genes, splice variants of MYC genes, and MYC gene polymorphisms. The term "MYC" is also used to refer to the polypeptide gene product of a MYC gene/transcript, e.g., a Myc protein, peptide, or polypeptide, such as those encoded by MYC Genbank Accession Nos. NP_002458.2 and NP_034979.3.

As used herein, a "MYC-associated disease or disorder" refers to a disease or disorder known in the art to be associated with altered MYC expression, level and/or activity. Notably, a "MYC-associated disease or disorder" includes cancer and/or proliferative diseases, conditions, or disorders. Certain exemplary "MYC-associated disease or disorders" include liver cancer (e.g. hepatocellular carcinoma or HCC), lung cancer (e.g., NSCLC), colorectal cancer, prostate cancer, pancreatic cancer, ovarian cancer, cervical cancer, brain cancer (e.g., glioblastoma), renal cancer (e.g., papillary renal carcinoma), stomach cancer, esophageal cancer, medulloblasoma, thyroid carcinoma, rhabdomyosarcoma, osteosarcoma, squamous cell carcinoma (e.g., oral squamous cell carcinoma), melanoma, breast cancer, and hematopoietic disorders (e.g., leukemias and lymphomas, and other immune cell-related disorders). Other hyperproliferative diseases or disorders may also be targeted, including, e.g., bladder, cervical (uterine), endometrial (uterine), head and neck, and oropharyngeal cancers.

By "proliferative disease" or "cancer" as used herein is meant, a disease, condition, trait, genotype or phenotype characterized by unregulated cell growth or replication as is known in the art; including hepatocellular carcinoma (HCC), leukemias, for example, acute myelogenous leukemia (AML), chronic myelogenous leukemia (CML), acute lymphocytic leukemia (ALL), and chronic lymphocytic leukemia, AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphoma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adeno carcinoma, parotid adenocarcinoma, endometrial sarcoma, multidrug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and other cancer or proliferative disease, condition, trait, genotype or phenotype that can respond to the modulation of disease related gene expression in a cell or tissue, alone or in combination with other therapies.

In certain embodiments, dsRNA-mediated inhibition of a MYC target sequence is assessed. In such embodiments, MYC RNA levels can be assessed by art-recognized methods (e.g., RT-PCR, Northern blot, expression array, etc.), optionally via comparison of MYC levels in the presence of an anti-MYC dsRNA of the invention relative to the absence of such an anti-MYC dsRNA. In certain embodiments, MYC levels in the presence of an anti-MYC dsRNA are compared to those observed in the presence of vehicle alone, in the presence of a dsRNA directed against an unrelated target RNA, or in the absence of any treatment.

It is also recognized that levels of Myc protein can be assessed and that Myc protein levels are, under different conditions, either directly or indirectly related to MYC RNA levels and/or the extent to which a dsRNA inhibits MYC expression, thus art-recognized methods of assessing Myc protein levels (e.g., Western blot, immunoprecipitation, other antibody-based methods, etc.) can also be employed to examine the inhibitory effect of a dsRNA of the invention.

An anti-MYC dsRNA of the invention is deemed to possess "MYC inhibitory activity" if a statistically significant reduction in MYC RNA (or when the Myc protein is assessed, Myc protein levels) is seen when an anti-MYC dsRNA of the invention is administered to a system (e.g., cell-free in vitro system), cell, tissue or organism, as compared to a selected control. The distribution of experimental values and the number of replicate assays performed will tend to dictate the parameters of what levels of reduction in MYC RNA (either as a % or in absolute terms) is deemed statistically significant (as assessed by standard methods of determining statistical significance known in the art). However, in certain embodiments, "MYC inhibitory activity" is defined based upon a % or absolute level of reduction in the level of MYC in a system, cell, tissue or organism. For example, in certain embodiments, a dsRNA of the invention is deemed to possess MYC inhibitory activity if at least a 5% reduction or at least a 10% reduction in MYC RNA is observed in the presence of a dsRNA of the invention relative to MYC levels seen for a suitable control. (For example, in vivo MYC levels in a tissue and/or subject can, in certain embodiments, be deemed to be inhibited by a dsRNA agent of the invention if, e.g., a 5% or 10% reduction in MYC levels is observed relative to a control.) In certain other embodiments, a dsRNA of the invention is deemed to possess MYC inhibitory activity if MYC RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of MYC is required for a dsRNA to be deemed to possess MYC inhibitory activity. In certain models (e.g., cell culture), a dsRNA is deemed to possess MYC inhibitory activity if at least a 50% reduction in MYC levels is observed relative to a suitable control. In certain other embodiments, a dsRNA is deemed to possess MYC inhibitory activity if at least an 80% reduction in MYC levels is observed relative to a suitable control.

By way of specific example, in Example 2 below, a series of DsiRNAs targeting MYC were tested for the ability to reduce MYC mRNA levels in human A549 or mouse Hepa 1-6 cells in vitro, at 1 nM concentrations in the environment of such cells and in the presence of a transfection agent (Lipofectamine™ RNAiMAX, Invitrogen). Within Example 2 below, MYC inhibitory activity was ascribed to those DsiRNAs that were observed to effect at least a 70% reduction of MYC mRNA levels under the assayed conditions. It is contemplated that MYC inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess MYC inhibitory activity if at least a 10% reduction, at least a 20% reduction, at least a 30% reduction, at least a 40% reduction, at least a 50% reduction, at least a 60% reduction, at least a 75% reduction, at least an 80% reduction, at least an 85% reduction, at least a 90% reduction, or at least a 95% reduction in MYC mRNA levels is observed in a mammalian cell line in vitro at 1 nM dsRNA concentration or lower in the environment of a cell, relative to a suitable control.

Use of other endpoints for determination of whether a double stranded RNA of the invention possesses MYC inhibitory activity is also contemplated. Specifically, in one embodiment, in addition to or as an alternative to assessing MYC mRNA levels, the ability of a tested dsRNA to reduce Myc protein levels (e.g., at 48 hours after contacting a mammalian cell in vitro or in vivo) is assessed, and a tested dsRNA is deemed to possess MYC inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in Myc protein levels is observed in a mammalian cell contacted with the assayed double stranded RNA in vitro or in vivo, relative to a suitable control. Additional endpoints contemplated include, e.g., assessment of a phenotype associated with reduction of MYC levels—e.g., reduction of growth of a contacted mammalian cell line in vitro and/or reduction of growth of a tumor in vivo, including, e.g., halting or reducing the growth of tumor or cancer cell levels as described in greater detail elsewhere herein.

MYC inhibitory activity can also be evaluated over time (duration) and over concentration ranges (potency), with assessment of what constitutes a dsRNA possessing MYC inhibitory activity adjusted in accordance with concentrations administered and duration of time following administration. Thus, in certain embodiments, a dsRNA of the invention is deemed to possess MYC inhibitory activity if at least a 50% reduction in MYC activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent MYC inhibitory agent if MYC inhibitory activity (e.g., in certain embodiments, at least 50% inhibition of MYC) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for MYC inhibitory activity as described herein. In certain embodiments, a potent MYC inhibitory dsRNA of the invention is defined as one that is capable of MYC inhibitory activity (e.g., in certain embodiments, at least 20% reduction of MYC levels) at a formulated concentration of 10 mg/kg or less when administered to a subject in an effective delivery vehicle (e.g., an effective lipid nanoparticle formulation). Preferably, a potent MYC inhibitory dsRNA of the invention is defined as one that is capable of MYC inhibitory activity (e.g., in certain embodiments, at least 50% reduction of MYC levels) at a formulated concentration of 5 mg/kg or less when administered to a subject in an effective delivery vehicle. More preferably, a potent MYC inhibitory dsRNA of the invention is defined as one that is capable of MYC inhibitory activity (e.g., in certain embodiments, at least 50% reduction of MYC levels) at a formulated concentration of 5 mg/kg or less when administered to a subject in an effective delivery vehicle. Optionally, a potent MYC inhibitory dsRNA of the invention is defined as one that is capable of MYC inhibitory activity (e.g., in certain embodiments, at least 50% reduction of MYC levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an $IC_{50}$ value associated with a DsiRNA/dsRNA).

MYC inhibitory levels and/or MYC levels may also be assessed indirectly, e.g., measurement of a reduction of the size, number and/or rate of growth or spread of polyps or tumors in a subject may be used to assess MYC levels and/or MYC inhibitory efficacy of a double-stranded nucleic acid of the instant invention.

In certain embodiments, the phrase "consists essentially of" is used in reference to the anti-MYC dsRNAs of the invention. In some such embodiments, "consists essentially of" refers to a composition that comprises a dsRNA of the invention which possesses at least a certain level of MYC inhibitory activity (e.g., at least 50% MYC inhibitory activity) and that also comprises one or more additional components and/or modifications that do not significantly impact the MYC inhibitory activity of the dsRNA. For example, in certain embodiments, a composition "consists essentially of" a dsRNA of the invention where modifications of the dsRNA of the invention and/or dsRNA-associated components of the composition do not alter the MYC inhibitory activity (optionally including potency or duration of MYC inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of MYC inhibitory activity (e.g., 80% reduction, 90% reduction, etc. in efficacy, duration and/or potency) occurs in the presence of additional components or modifications, yet where MYC inhibitory activity is not significantly elevated (e.g., observed levels of MYC inhibitory activity are within 10% those observed for the isolated dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-CH₂—O-2'-bridge, 4'-(CH₂)₂—O-2'-bridge, 2'-LNA or other bicyclic or "bridged" nucleoside analog, and 2'-O—(N-methylcarbamate) or those comprising base analogs. In connection with 2'-modified nucleotides as described for the present disclosure, by "amino" is meant 2'-NH₂ or 2'-O—NH₂, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of an adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., *Nature* 1990 Aug. 16; 346(6285):680-2; Heus and Pardi, *Science* 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM NaHPO$_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., Proc Natl Acad Sci USA. 1990 November; 87(21):8467-71; Antao et al., Nucleic Acids Res. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002; SHINJI et al. Nippon Kagakkai Koen Yokoshu VOL.78th; NO.2; PAGE.731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the MYC gene/RNA.

An anti-MYC DsiRNA of the instant invention possesses strand lengths of at least 25 nucleotides. Accordingly, in certain embodiments, an anti-MYC DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-MYC DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-MYC DsiRNA agent is comprised of two oligonucleotide strands of differing lengths, with the anti-MYC DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

As used herein, a dsRNA, e.g., DsiRNA or siRNA, having a sequence "sufficiently complementary" to a target RNA or cDNA sequence (e.g., MYC mRNA) means that the dsRNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsRNA that is "sufficiently complementary" to a target RNA or cDNA sequence to trigger the destruction of the target RNA by the RNAi machinery or process can be identified as a dsRNA that causes a detectable reduction in the level of the target RNA in an appropriate assay of dsRNA activity (e.g., an in vitro assay as described in Example 2 below), or, in further examples, a dsRNA that is sufficiently complementary to a target RNA or cDNA sequence to trigger the destruction of the target RNA by the RNAi machinery or process can be identified as a dsRNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsRNA activity. In additional examples, a dsRNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsRNA that is sufficiently complementary to a target RNA or cDNA sequence to trigger the destruction of the target RNA by the RNAi machinery or process can be identified as a dsRNA capable of reducing target mRNA levels by at least 20% at least 48 hours post-administration of said dsRNA to a cell or organism. Preferably, a dsRNA that is sufficiently complementary to a target RNA or cDNA sequence to trigger the destruction of the target RNA by the RNAi machinery or process is identified as a dsRNA capable of reducing target mRNA levels by at least 40% at least 72 hours post-administration of said dsRNA to a cell or organism, by at least 40% at least four, five or seven days post-administration of said dsRNA to a cell or organism, by at least 50% at least 48 hours post-administration of said dsRNA to a cell or organism, by at least 50% at least 72 hours post-administration of said dsRNA to a cell or organism, by at least 50% at least four, five or seven days post-administration of said dsRNA to a cell or organism, by at least 80% at least 48 hours post-administration of said dsRNA to a cell or organism, by at least 80% at least 72 hours post-administration of said dsRNA to a cell or organism, or by at least 80% at least four, five or seven days post-administration of said dsRNA to a cell or organism.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-MYC DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5' end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to certain dsRNAs of the invention (e.g., "DsiRNAs"), the duplex formed by a dsRNA

TABLE 1

| | final conc. | Vender | Cat# | Lot# | m.w/Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| $MgCl_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| $NaH_2PO_4$ | 1 mM | Sigma | S-3193 | 52H-029515 | 120.0 | 0.006 g |
| EDTA | 0.02 mM | Sigma | E-7889 | 110K89271 | 0.5M | 2 µL |
| $H_2O$ | | Sigma | W-4502 | 51K2359 | | to 50 mL |
| pH = 7.0 at 20° C. | | | | adjust with HCl | | |

Useful variations on hybridization conditions will be readily apparent to those skilled in the art. Hybridization techniques are well known to those skilled in the art and are described, for example, in Benton and Davis (Science 196:

region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 µL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) *Science* 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the MYC target gene in a cell or mammal, wherein the dsRNA comprises an antisense strand comprising a region of complementarity which is complementary to at least a part of an mRNA formed in the expression of the MYC target gene, and wherein the region of complementarity is less than 35 nucleotides in length, optionally 19-24 nucleotides in length or 25-30 nucleotides in length, and wherein the dsRNA, upon contact with a cell expressing the MYC target gene, inhibits the expression of the MYC target gene by at least 10%, 25%, or 40%.

A dsRNA of the invention comprises two RNA strands that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the MYC target gene, the other strand (the sense strand) comprises a region which is complementary to the antisense strand, such that the two strands hybridize and form a duplex structure when combined under suitable conditions. Generally, the duplex structure is between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Table 5, minus only a few nucleotides on one or both ends may be similarly effective as compared to the dsRNAs described above and in Tables 2-4 and 6-7. Hence, dsRNAs comprising a partial sequence of at least 15, 16, 17, 18, 19, 20, or more contiguous nucleotides sufficiently complementary to one of the sequences of Table 5, and differing in their ability to inhibit the expression of the MYC target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of MYC possessing perfect complementarity with the presently described dsRNA agents, but also against target MYC RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target MYC RNA, e.g., of a specific allelic variant of MYC (e.g., an allele of enhanced therapeutic interest). Indeed, dsRNA agent sequences with insertions, deletions, and single point mutations relative to the target MYC sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) Proc. Natl. Acad. Sci. USA 87:2264-68, modified as in Karlin and Altschul (1993) Proc. Natl. Acad. Sci. USA 90:5873-77. Such an algorithm is incorporated into the BLAST programs (version 2.0) of Altschul, et al. (1990) J. Mol. Biol. 215:403-10.

In another embodiment, a gapped alignment the alignment is optimized is formed by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized is formed by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the MYC RNA sequence is preferred. Alternatively, the dsRNA may be defined functionally as a nucleotide sequence (or oligonucleotide sequence) that is capable of hybridizing with a portion of the MYC RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, $Tm(° C.)=2(\# of A+T bases)+4(\# of G+C bases)$. For hybrids between 18 and 49 base pairs in length, $Tm(° C.)=81.5+16.6(\log 10[Na+])+0.41 (\% G+C)-(600/N)$, where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target MYC, in certain embodiments, the target nucleic acid is MYC RNA, e.g., in certain embodiments, MYC mRNA. MYC RNA target sites can also interchangeably be referenced by corresponding cDNA sequences. Levels of MYC may also be targeted via targeting of upstream effectors of MYC, or the effects of modulated or misregulated MYC may also be modulated by targeting of molecules downstream of MYC in the MYC signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

In one embodiment, dsRNA molecules of the invention that down regulate or reduce MYC gene expression are used for treating, preventing or reducing MYC-related diseases or disorders (e.g., cancer) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (MYC) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA interference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an $IC_{50}$ curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing MYC target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention. Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an $IC_{50}$ assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a 13-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-MYC DsiRNA Agents

In certain embodiments, the anti-MYC DsiRNA agents of the invention can have the following structures:

In one such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA and "Y" is an overhang domain comprised of 1-4 RNA monomers that are optionally 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M7" or "M7" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand.

In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M6" or "M6" modification pattern.

In other embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In another related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M5" or "M5" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
```

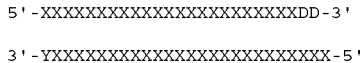

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

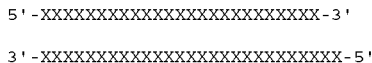

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

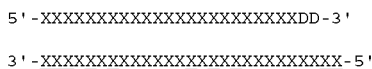

wherein "X"=RNA and "X"=2'-O-methyl RNA. The top strand is the sense strand, and the bottom strand is the antisense strand. In a further related embodiment, the DsiRNA comprises:

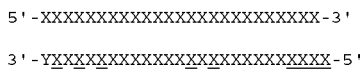

wherein "X"=RNA, "X"=2'-O-methyl RNA, and "D"=DNA. The top strand is the sense strand, and the bottom strand is the antisense strand. This modification pattern is also referred to herein as the "AS-M4" or "M4" modification pattern.

In additional embodiments, the DsiRNA comprises:

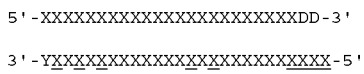

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

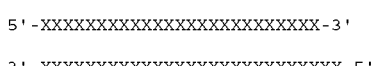

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

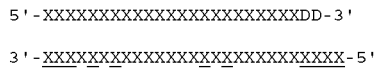

wherein "X"=RNA and "X"=2'-O-methyl RNA. The top strand is the sense strand, and the bottom strand is the antisense strand. In a further related embodiment, the DsiRNA comprises:

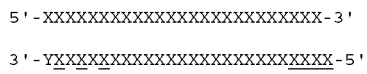

wherein "X"=RNA, "X"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

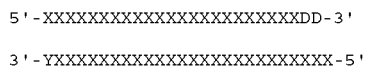

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

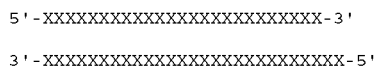

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

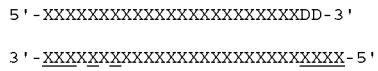

wherein "X"=RNA and "X"=2'-O-methyl RNA. The top strand is the sense strand, and the bottom strand is the antisense strand. In a further related embodiment, the DsiRNA comprises:

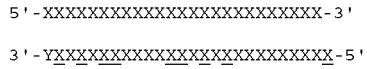

wherein "X"=RNA, "X"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

5'-XXXXXXXXXXXXXXXXXXXXXXXXX-3'
3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

```
5'-XXXXXXXXXXXXXXXXXXXXXXXXX-3'

3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'

3'-YXXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

```
5'-XXXXXXXXXXXXXXXXXXXXXXXXX-3'

3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'

3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13" or "M13" modification pattern.

In other embodiments, the DsiRNA comprises:

```
5'-XXXXXXXXXXXXXXXXXXXXXXX-3'

3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

```
5'-XXXXXXXXXXXXXXXXXXXXXXXDD-3'

3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'

3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

```
5'-XXXXXXXXXXXXXXXXXXXXXXX-3'

3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'

3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

```
5'-XXXXXXXXXXXXXXXXXXXXXXX-3'

3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15" or "M15" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

```
5'-XXXXXXXXXXXXXXXXXXXXXXXXX-3'

3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M24" or "M24" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M30" or "M30" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
```

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

```
5'-XXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41" or "M41" modification pattern.

In further embodiments, the DsiRNA comprises:

```
5'-XXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36" or "M36" modification pattern.

In additional embodiments, the DsiRNA comprises:

```
5'-XXXXXXXXXXXXXXXXXXXXXXX-3'
3'-YXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXX-5'
``` wherein "X"=RNA, "X̱"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̱X̱X̱X̱X̱XXXXXXXXXXXXXXXXXXXXXXXX-5'
``` wherein "X"=RNA and "X̱"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-X̱X̱X̱X̱X̱XXXXXXXXXXXXXXXXXXXXXXXX-5'
``` wherein "X"=RNA, "X̱"=2'-O-methyl RNA, and "D"=DNA. The top strand is the sense strand, and the bottom strand is the antisense strand. This modification pattern is also referred to herein as the "AS-M42" or "M42" modification pattern.

In further embodiments, the DsiRNA comprises:

```
5'-XXXXXXXXXXXXXXXXXXXXXXXXX-3'
3'-YX̱XXXXXXXXXXXX̱X̱XXXXXXXXX̱X̱X̱X̱-5'
``` wherein "X"=RNA, "X̱"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YX̱XXXXXXXXXXXX̱X̱XXXXXXXXX̱X̱X̱X̱-5'
``` wherein "X"=RNA, "X̱"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̱X̱X̱X̱X̱XXXXXXXXXXXXXXXXXXXXXXXX-5'
``` wherein "X"=RNA and "X̱"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-X̱X̱X̱X̱X̱XXXXXXXXXXXXXXXXXXXXXXXX-5'
``` wherein "X"=RNA, "X̱"=2'-O-methyl RNA, and "D"=DNA. The top strand is the sense strand, and the bottom strand is the antisense strand. This modification pattern is also referred to herein as the "AS-M43" or "M43" modification pattern.

In additional embodiments, the DsiRNA comprises:

```
5'-XXXXXXXXXXXXXXXXXXXXXXXXX-3'
3'-YXXXXXXXXXXXXX̱X̱XXXXXXXXXX̱X̱X̱X̱-5'
``` wherein "X"=RNA, "X̱"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXX̱X̱XXXXXXXXXX̱X̱X̱X̱-5'
``` wherein "X"=RNA, "X̱"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-X̱X̱X̱X̱X̱XXXXXXXXXXXXXXXXXXXXXXXX-5'
``` wherein "X"=RNA and "X̱"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-X̱X̱X̱X̱X̱XXXXXXXXXXXXXXXXXXXXXXXX-5'
``` wherein "X"=RNA, "X̱"=2'-O-methyl RNA, and "D"=DNA. The top strand is the sense strand, and the bottom strand is the antisense strand. This modification pattern is also referred to herein as the "AS-M44" or "M44" modification pattern.

In further embodiments, the DsiRNA comprises:

```
5'-XXXXXXXXXXXXXXXXXXXXXXXXX-3'
3'-YX̱X̱X̱X̱X̱XXXXXX̱X̱XXXXXXXXXXXX-5'
``` wherein "X"=RNA, "X̱"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YX̱X̱X̱X̱X̱XXXXXX̱X̱XXXXXXXXXXXX-5'
``` wherein "X"=RNA, "X̱"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M45" or "M45" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M46" or "M46" modification pattern.

In further embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'

3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M47" or "M47" modification pattern.

In additional embodiments, the DsiRNA comprises:

```
5'-XXXXXXXXXXXXXXXXXXXXXXXXX-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'

3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'

3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

wherein "X"=RNA, "X̲"=2'-O-methyl RNA, and "D"=DNA. The top strand is the sense strand, and the bottom strand is the antisense strand. This modification pattern is also referred to herein as the "AS-M48" or "M48" modification pattern.

In further embodiments, the DsiRNA comprises:

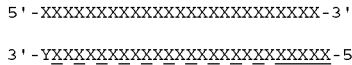

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

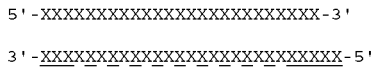

wherein "X"=RNA and "X̲"=2'-O-methyl RNA. The top strand is the sense strand, and the bottom strand is the antisense strand. In a further related embodiment, the DsiRNA comprises:

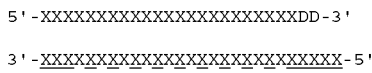

wherein "X"=RNA, "X̲"=2'-O-methyl RNA, and "D"=DNA. The top strand is the sense strand, and the bottom strand is the antisense strand. This modification pattern is also referred to herein as the "AS-M52" or "M52" modification pattern.

In further embodiments, the DsiRNA comprises:

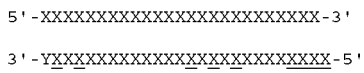

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

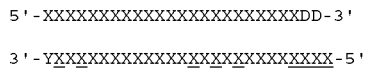

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

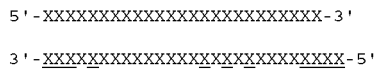

wherein "X"=RNA and "X̲"=2'-O-methyl RNA. The top strand is the sense strand, and the bottom strand is the antisense strand. In a further related embodiment, the DsiRNA comprises:

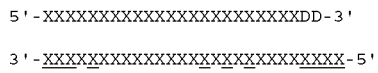

wherein "X"=RNA, "X̲"=2'-O-methyl RNA, and "D"=DNA. The top strand is the sense strand, and the bottom strand is the antisense strand. This modification pattern is also referred to herein as the "AS-M54" or "M54" modification pattern.

In additional embodiments, the DsiRNA comprises:

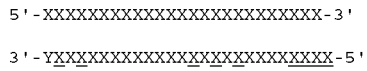

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

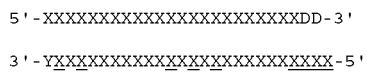

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

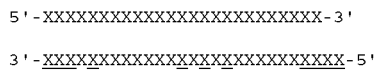

wherein "X"=RNA and "X̲"=2'-O-methyl RNA. The top strand is the sense strand, and the bottom strand is the antisense strand. In a further related embodiment, the DsiRNA comprises:

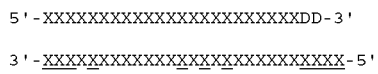

wherein "X"=RNA, "X"=2'-O-methyl RNA, and "D"=DNA. The top strand is the sense strand, and the bottom strand is the antisense strand. This modification pattern is also referred to herein as the "AS-M55" or "M55" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M56" or "M56" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M57" or "M57" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M58" or "M58" modification pattern.

In additional embodiments, the DsiRNA comprises:

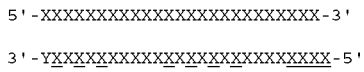

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

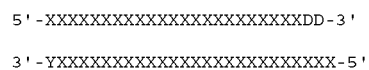

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

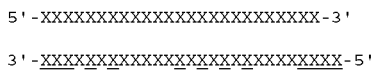

wherein "X"=RNA and "X"=2'-O-methyl RNA. The top strand is the sense strand, and the bottom strand is the antisense strand. In a further related embodiment, the DsiRNA comprises:

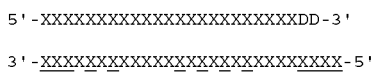

wherein "X"=RNA, "X"=2'-O-methyl RNA, and "D"=DNA. The top strand is the sense strand, and the bottom strand is the antisense strand. This modification pattern is also referred to herein as the "AS-M59" or "M59" modification pattern.

In further embodiments, the DsiRNA comprises:

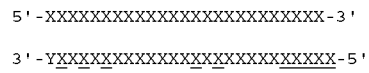

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

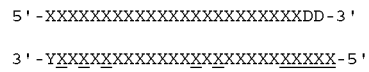

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

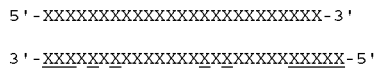

wherein "X"=RNA and "X"=2'-O-methyl RNA. The top strand is the sense strand, and the bottom strand is the antisense strand. In a further related embodiment, the DsiRNA comprises:

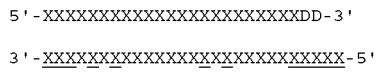

wherein "X"=RNA, "X"=2'-O-methyl RNA, and "D"=DNA. The top strand is the sense strand, and the bottom strand is the antisense strand. This modification pattern is also referred to herein as the "AS-M60" or "M60" modification pattern.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

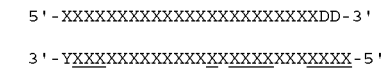

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

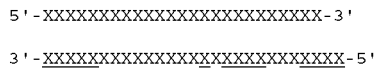

wherein "X"=RNA and "X"=2'-O-methyl RNA. The top strand is the sense strand, and the bottom strand is the antisense strand. In a further related embodiment, the DsiRNA comprises:

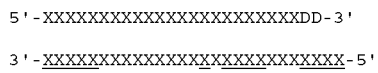

wherein "X"=RNA, "X"=2'-O-methyl RNA, and "D"=DNA. The top strand is the sense strand, and the bottom strand is the antisense strand. This modification pattern is also referred to herein as the "AS-M61" or "M61" modification pattern.

In further embodiments, the DsiRNA comprises:

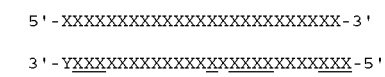

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

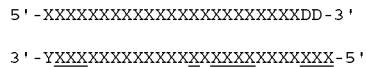

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

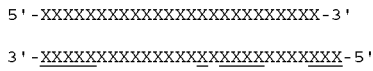

wherein "X"=RNA and "X"=2'-O-methyl RNA. The top strand is the sense strand, and the bottom strand is the antisense strand. In a further related embodiment, the DsiRNA comprises:

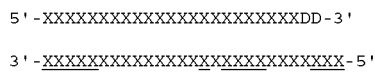

wherein "X"=RNA, "X"=2'-O-methyl RNA, and "D"=DNA. The top strand is the sense strand, and the bottom strand is the antisense strand. This modification pattern is also referred to herein as the "AS-M62" or "M62" modification pattern.

In additional embodiments, the DsiRNA comprises:

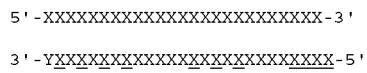

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

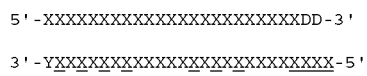

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

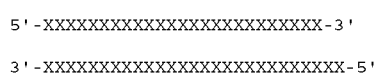

wherein "X"=RNA and "X"=2'-O-methyl RNA. The top strand is the sense strand, and the bottom strand is the antisense strand. In a further related embodiment, the DsiRNA comprises:

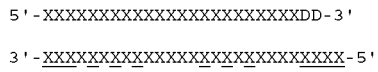

wherein "X"=RNA, "X"=2'-O-methyl RNA, and "D"=DNA. The top strand is the sense strand, and the bottom strand is the antisense strand. This modification pattern is also referred to herein as the "AS-M63" or "M63" modification pattern.

In further embodiments, the DsiRNA comprises:

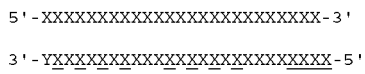

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

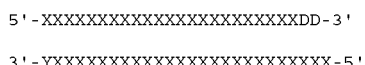

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

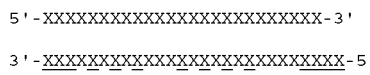

wherein "X"=RNA and "X"=2'-O-methyl RNA. The top strand is the sense strand, and the bottom strand is the antisense strand. In a further related embodiment, the DsiRNA comprises:

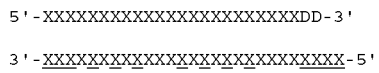

wherein "X"=RNA, "X"=2'-O-methyl RNA, and "D"=DNA. The top strand is the sense strand, and the bottom strand is the antisense strand. This modification pattern is also referred to herein as the "AS-M64" or "M64" modification pattern.

In additional embodiments, the DsiRNA comprises:

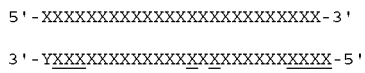

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

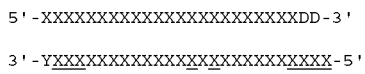

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

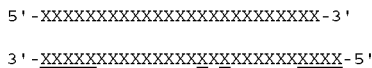

wherein "X"=RNA and "X"=2'-O-methyl RNA. The top strand is the sense strand, and the bottom strand is the antisense strand. In a further related embodiment, the DsiRNA comprises:

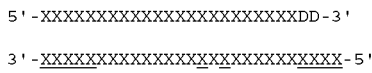

wherein "X"=RNA, "X"=2'-O-methyl RNA, and "D"=DNA. The top strand is the sense strand, and the bottom strand is the antisense strand. This modification pattern is also referred to herein as the "AS-M65" or "M65" modification pattern.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

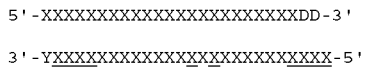

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

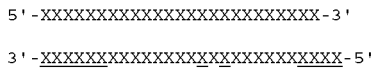

wherein "X"=RNA and "X"=2'-O-methyl RNA. The top strand is the sense strand, and the bottom strand is the antisense strand. In a further related embodiment, the DsiRNA comprises:

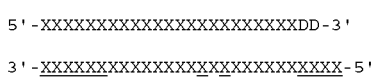

wherein "X"=RNA, "X"=2'-O-methyl RNA, and "D"=DNA. The top strand is the sense strand, and the bottom strand is the antisense strand. This modification pattern is also referred to herein as the "AS-M66" or "M66" modification pattern.

In additional embodiments, the DsiRNA comprises:

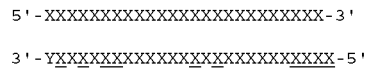

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

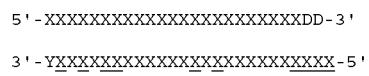

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

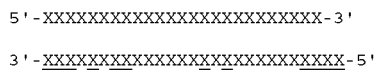

wherein "X"=RNA and "X"=2'-O-methyl RNA. The top strand is the sense strand, and the bottom strand is the antisense strand. In a further related embodiment, the DsiRNA comprises:

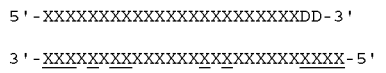

wherein "X"=RNA, "X"=2'-O-methyl RNA, and "D"=DNA. The top strand is the sense strand, and the bottom strand is the antisense strand. This modification pattern is also referred to herein as the "AS-M67" or "M67" modification pattern.

In further embodiments, the DsiRNA comprises:

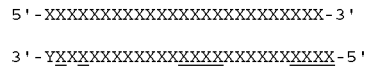

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

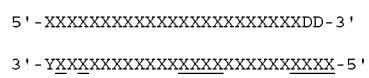

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M68" or "M68" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M69" or "M69" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M70" or "M70" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

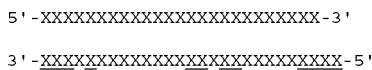

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M71" or "M71" modification pattern.

In further embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M72" or "M72" modification pattern.

In additional embodiments, the DsiRNA comprises:

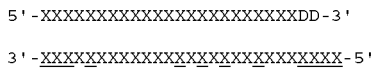

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

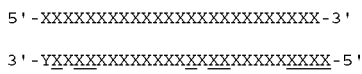

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

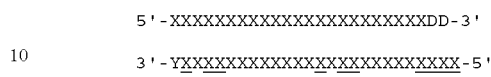

wherein "X"=RNA and "X"=2'-O-methyl RNA. The top strand is the sense strand, and the bottom strand is the antisense strand. In a further related embodiment, the DsiRNA comprises:

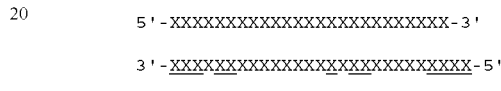

wherein "X"=RNA, "X"=2'-O-methyl RNA, and "D"=DNA. The top strand is the sense strand, and the bottom strand is the antisense strand. This modification pattern is also referred to herein as the "AS-M73" or "M73" modification pattern.

In additional embodiments, the DsiRNA comprises:

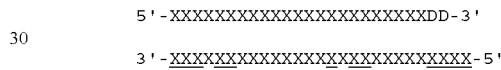

wherein "X"=RNA and "X"=2'-O-methyl RNA. In a further related embodiment, the DsiRNA comprises:

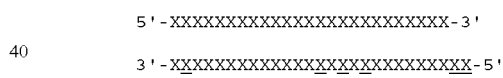

wherein "X"=RNA, "X"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

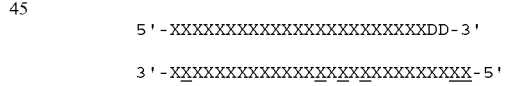

wherein "X"=RNA and "X"=2'-O-methyl RNA. The top strand is the sense strand, and the bottom strand is the antisense strand. In a further related embodiment, the DsiRNA comprises:

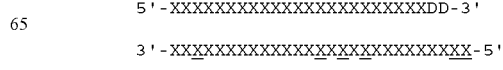

wherein "X"=RNA, "X̲"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

```
5'-XXXXXXXXXXXXXXXXXXXXXXXXX-3'
3'-X̲XXXXXXXXX̲XXXXXXXXX̲XXXXXXXXX̲-5'
``` wherein "X"=RNA and "X̲"=2'-O-methyl RNA. The top strand is the sense strand, and the bottom strand is the antisense strand. In another related embodiment, the DsiRNA comprises:

```
5'-XXXXXXXXXXXXXXXXXXXXXXXDD-3'
3'-X̲XXXXXXXXX̲XXXXXXXXX̲XXXXXXXXX̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

```
5'-XXXXXXXXXXXXXXXXXXXXXXXXX-3'
3'-X̲XXXXXXXXX̲XXXXXXXXX̲XXXXXXXXX̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXX̲XXXXXXXXX̲XXXXXXXXX̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

```
5'-XXXXXXXXXXXXXXXXXXXXXXXXX-3'
3'-X̲XXXXXXXXX̲XXXXXXXXX̲XXXXXXXXX̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXX̲XXXXXXXXX̲XXXXXXXXX̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'
3'-X̲XXXXXXXXX̲XXXXXXXXX̲XXXXXXXXX̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXX̲XXXXXXXXX̲XXXXXXXXX̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'
3'-X̲XXXXXXXXX̲XXXXXXXXX̲XXXXXXXXX̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXX̲XXXXXXXXX̲XXXXXXXXX̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'
3'-X̲XXXXXXXXX̲XXXXXXXXX̲XXXXXXXXX̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXX̲XXXXXXXXX̲XXXXXXXXX̲-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'
3'-X̲XXXXXXXXX̲XXXXXXXXX̲XXXXXXXXX̲-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-X̲XXXXXXXXX̲XXXXXXXXX̲XXXXXXXXX̲-5'
``` wherein "X"=RNA, "X"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

```
5'-XXXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41*" or "M41*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36*" or "M36*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M42*" or "M42*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M43*" or "M43*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M44*" or "M44*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M46*" or "M46*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M47*" or "M47*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M48*" or "M48*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M52*" or "M52*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M54*" or "M54*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M55*" or "M55*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M56*" or "M56*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M57*" or "M57*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M58*" or "M58*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M59*" or "M59*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M60*" or "M60*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M61*" or "M61*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M62*" or "M62*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M63*" or "M63*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M64*" or "M64*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M65*" or "M65*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M66*" or "M66*" modification pattern.

In additional embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M67*" or "M67*" modification pattern.

In further embodiments, the DsiRNA comprises:

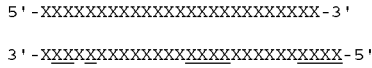

wherein "X"=RNA and "X"=2'-O-methyl RNA. The top strand is the sense strand, and the bottom strand is the antisense strand. In a further related embodiment, the DsiRNA comprises:

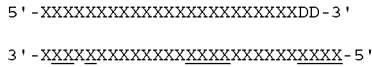

wherein "X"=RNA, "X"=2'-O-methyl RNA, and "D"=DNA. The top strand is the sense strand, and the bottom strand is the antisense strand. This modification pattern is also referred to herein as the "AS-M68*" or "M68*" modification pattern.

In additional embodiments, the DsiRNA comprises:

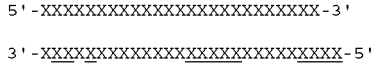

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M69*" or "M69*" modification pattern.

In further embodiments, the DsiRNA comprises:

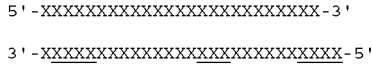

wherein "X"=RNA and "X"=2'-O-methyl RNA. The top strand is the sense strand, and the bottom strand is the antisense strand. In a further related embodiment, the DsiRNA comprises:

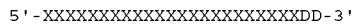
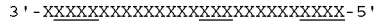

wherein "X"=RNA, "X"=2'-O-methyl RNA, and "D"=DNA. The top strand is the sense strand, and the bottom strand is the antisense strand. This modification pattern is also referred to herein as the "AS-M70*" or "M70*" modification pattern.

In additional embodiments, the DsiRNA comprises:

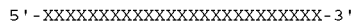
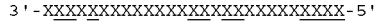

wherein "X"=RNA and "X"=2'-O-methyl RNA. The top strand is the sense strand, and the bottom strand is the antisense strand. In a further related embodiment, the DsiRNA comprises:

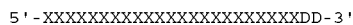
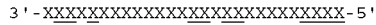

wherein "X"=RNA, "X"=2'-O-methyl RNA, and "D"=DNA. The top strand is the sense strand, and the bottom strand is the antisense strand. This modification pattern is also referred to herein as the "AS-M71*" or "M71*" modification pattern.

In further embodiments, the DsiRNA comprises:

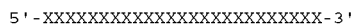
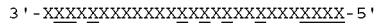

wherein "X"=RNA and "X"=2'-O-methyl RNA. The top strand is the sense strand, and the bottom strand is the antisense strand. In a further related embodiment, the DsiRNA comprises:

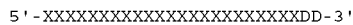
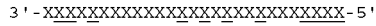

wherein "X"=RNA, "X"=2'-O-methyl RNA, and "D"=DNA. The top strand is the sense strand, and the bottom strand is the antisense strand. This modification pattern is also referred to herein as the "AS-M72*" or "M72*" modification pattern.

In additional embodiments, the DsiRNA comprises:

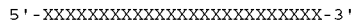
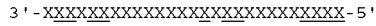

wherein "X"=RNA and "X"=2'-O-methyl RNA. The top strand is the sense strand, and the bottom strand is the antisense strand. In a further related embodiment, the DsiRNA comprises:

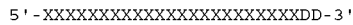
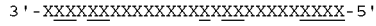

wherein "X"=RNA, "X"=2'-O-methyl RNA, and "D"=DNA. The top strand is the sense strand, and the bottom strand is the antisense strand. This modification pattern is also referred to herein as the "AS-M73*" or "M73*" modification pattern.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

```
5'-XXXXXXXXXXXXXXXXXXXXXXXDD-3' "SM1"
5'-XXXXXXXXXXXXXXXXXXXXXXXDD-3' "SM2"
5'-XXXXXXXXXXXXXXXXXXXXXXXDD-3' "SM3"
5'-XXXXXXXXXXXXXXXXXXXXXXXDD-3' "SM4"
5'-XXXXXXXXXXXXXXXXXXXXXXXDD-3' "SM5"
5'-XXXXXXXXXXXXXXXXXXXXXXXDD-3' "SM6"
5'-XXXXXXXXXXXXXXXXXXXXXXXDD-3' "SM7"
5'-XXXXXXXXXXXXXXXXXXXXXXXDD-3' "SM8"
5'-XXXXXXXXXXXXXXXXXXXXXXXDD-3' "SM9"
5'-XXXXXXXXXXXXXXXXXXXXXXXDD-3' "SM10"
5'-XXXXXXXXXXXXXXXXXXXXXXXDD-3' "SM11"
5'-XXXXXXXXXXXXXXXXXXXXXXXDD-3' "SM12"
5'-XXXXXXXXXXXXXXXXXXXXXXXDD-3' "SM13"
5'-XXXXXXXXXXXXXXXXXXXXXXXDD-3' "SM14"
5'-XXXXXXXXXXXXXXXXXXXXXXXDD-3' "SM15"
5'-XXXXXXXXXXXXXXXXXXXXXXXDD-3' "SM16"
5'-XXXXXXXXXXXXXXXXXXXXXXXDD-3' "SM17"
5'-XXXXXXXXXXXXXXXXXXXXXXXDD-3' "SM18"
5'-XXXXXXXXXXXXXXXXXXXXXXXDD-3' "SM19"
5'-XXXXXXXXXXXXXXXXXXXXXXXDD-3' "SM20"
5'-XXXXXXXXXXXXXXXXXXXXXXXDD-3' "SM21"
5'-XXXXXXXXXXXXXXXXXXXXXXXDD-3' "SM23"
5'-XXXXXXXXXXXXXXXXXXXXXXXDD-3' "SM24"
5'-XXXXXXXXXXXXXXXXXXXXXXXDD-3' "SM25"
5'-XXXXXXXXXXXXXXXXXXXXXXXDD-3' "SM30"
5'-XXXXXXXXXXXXXXXXXXXXXXXDD-3' "SM31"
5'-XXXXXXXXXXXXXXXXXXXXXXXDD-3' "SM32"
5'-XXXXXXXXXXXXXXXXXXXXXXXDD-3' "SM33"
5'-XXXXXXXXXXXXXXXXXXXXXXXDD-3' "SM34"
5'-XXXXXXXXXXXXXXXXXXXXXXXDD-3' "SM35"
5'-XXXXXXXXXXXXXXXXXXXXXXXDD-3' "SM36"
5'-XXXXXXXXXXXXXXXXXXXXXXXDD-3' "SM37"
5'-XXXXXXXXXXXXXXXXXXXXXXXDD-3' "SM38"
5'-XXXXXXXXXXXXXXXXXXXXXXXDD-3' "SM39"
5'-XXXXXXXXXXXXXXXXXXXXXXXDD-3' "SM40"
5'-XXXXXXXXXXXXXXXXXXXXXXXDD-3' "SM41"
```

-continued

```
5'-XXXXXXXXXXXXXXXXXXXXXXXDD-3' "SM42"
5'-XXXXXXXXXXXXXXXXXXXXXXXDD-3' "SM43"
5'-XXXXXXXXXXXXXXXXXXXXXXXDD-3' "SM44"
5'-XXXXXXXXXXXXXXXXXXXXXXXDD-3' "SM45", "SM47"
5'-XXXXXXXXXXXXXXXXXXXXXXXDD-3' "SM46"
5'-XXXXXXXXXXXXXXXXXXXXXXXDD-3' "SM48"
5'-XXXXXXXXXXXXXXXXXXXXXXXDD-3' "SM49"
5'-XXXXXXXXXXXXXXXXXXXXXXXDD-3' "SM50"
5'-XXXXXXXXXXXXXXXXXXXXXXXDD-3' "SM51"
5'-XXXXXXXXXXXXXXXXXXXXXXXDD-3' "SM52"
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
5'-XXXXXXXXXXXXXXXXXXXXXXXX-3'
```

```
5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'

5'-XXXXXXXXXXXXXXXXXXXXXXXXXXX-3'   "SM22"
``` where "X"=RNA, "X"=2'-O-methyl RNA, and "D"=DNA.

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

```
5'-XXXXXXXXXXXXXXXXXXXXXXXXXM$M^{M-3'}$
3'-XXXXXXXXXXXXXXXXXXXXXXXXXM$M_{M-5'}$
``` wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

```
5'-XXXXXXXXXXXXXXXXXXXXXXXXX$X_{N*}D_N$DD-3'

3'-YXXXXXXXXXXXXXXXXXXXXXXXX$X_{N*}D_N$XX-5'
``` wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

```
5'-XXXXXXXXXXXXXXXXXXXXXXXXX$X_{N*}D_N$DD-3'

3'-YXXXXXXXXXXXXXXXXXXXXXXXX$X_{N*}D_N$DD-5'
``` wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

```
5'-XXXXXXXXXXXXXXXXXXXXXXXXX$X_{N*}D_N$DD-3'

3'-YXXXXXXXXXXXXXXXXXXXXXXXX$X_{N*}D_N$ZZ-5'
``` wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

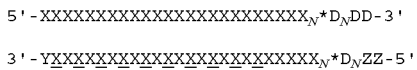

wherein "X"=RNA, "X"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

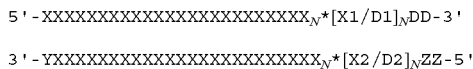

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

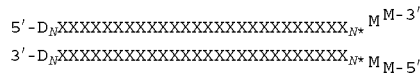

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

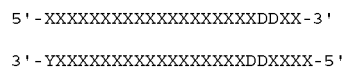

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O- methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

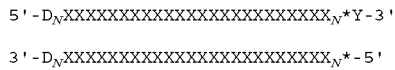

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

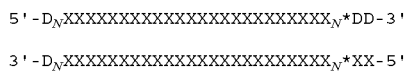

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

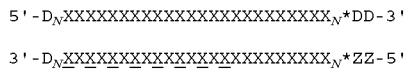

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

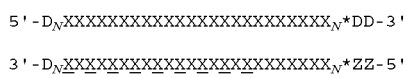

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

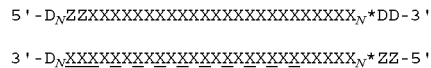

wherein "X"=RNA, "$\underline{X}$"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

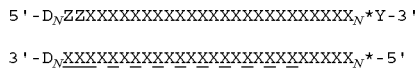

wherein "X"=RNA, "$\underline{X}$"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

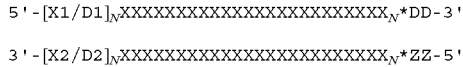

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

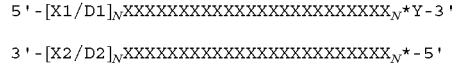

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

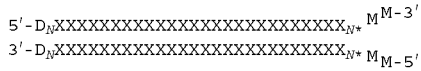

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

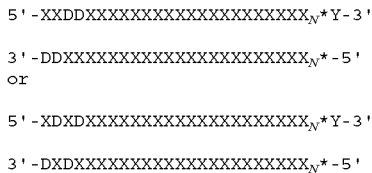

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetraloop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary MYC targeting DsiRNA agents of the invention, and their associated MYC target sequences, include the following, presented in the below series of tables:
Table Number:
(2) Selected Human Anti-MYC DsiRNA Agents (Asymmetrics);
(3) Selected Human Anti-MYC DsiRNAs, Unmodified Duplexes (Asymmetrics);
(4) Selected Mouse Anti-MYC DsiRNAs (Asymmetrics);
(5) DsiRNA Target Sequences (21mers) In MYC mRNA;
(6) Selected Human Anti-MYC "Blunt/Fray" DsiRNAs;
(7) Selected Human Anti-MYC "Blunt/Blunt" DsiRNAs; and
(8) DsiRNA Component 19 Nucleotide Target Sequences In MYC mRNA

TABLE 2

Selected Human Anti-MYC DsiRNA Agents (Asymmetrics)

|  |  |
|---|---|
|  | 5'-CGAGAAGGGCAGGGCUUCUCAGAgg-3' (SEQ ID NO: 1) |
|  | 3'-<u>GAG</u>CUCUUCCCGUCCCGAAGAGUCU<u>CC</u>-5' (SEQ ID NO: 328) |
| MYC-94 Target: | 5'-CTCGAGAAGGGCAGGGCTTCTCAGAGG-3' (SEQ ID NO: 655) |
|  | 5'-GCUUUAUCUAACUCGCUGUAGUAat-3' (SEQ ID NO: 2) |
|  | 3'-<u>CCC</u>GAAAUAGAUUGAGCGACAUCAU<u>UA</u>-5' (SEQ ID NO: 329) |
| MYC-178 Target: | 5'-GGGCTTTATCTAACTCGCTGTAGTAAT-3' (SEQ ID NO: 656) |
|  | 5'-CCCUUGCCGCAUCCACGAAACUUtg-3' (SEQ ID NO: 3) |
|  | 3'-<u>UU</u>GGGAACGGCGUAGGUGCUUUGAA<u>AC</u>-5' (SEQ ID NO: 330) |
| MYC-365 Target: | 5'-AACCCTTGCCGCATCCACGAAACTTTG-3' (SEQ ID NO: 657) |
|  | 5'-GCCGCAUCCACGAAACUUUGCCCat-3' (SEQ ID NO: 4) |
|  | 3'-<u>AA</u>CGGCGUAGGUGCUUUGAAACGGG<u>UA</u>-5' (SEQ ID NO: 331) |
| MYC-370 Target: | 5'-TTGCCGCATCCACGAAACTTTGCCCAT-3' (SEQ ID NO: 658) |
|  | 5'-UCCACGAAACUUUGCCCAUAGCAgc-3' (SEQ ID NO: 5) |
|  | 3'-<u>GU</u>AGGUGCUUUGAAACGGGUAUCGU<u>CG</u>-5' (SEQ ID NO: 332) |
| MYC-376 Target: | 5'-CATCCACGAAACTTTGCCCATAGCAGC-3' (SEQ ID NO: 659) |
|  | 5'-GCGGGCACUUUGCACUGGAACUUac-3' (SEQ ID NO: 6) |
|  | 3'-<u>CCC</u>GCCCGUGAAACGUGACCUUGAA<u>UG</u>-5' (SEQ ID NO: 333) |
| MYC-403 Target: | 5'-GGGCGGGCACTTTGCACTGGAACTTAC-3' (SEQ ID NO: 660) |
|  | 5'-ACUUUGCACUGGAACUUACAACAcc-3' (SEQ ID NO: 7) |
|  | 3'-<u>CGU</u>GAAACGUGACCUUGAAUGUUGU<u>GG</u>-5' (SEQ ID NO: 334) |
| MYC-409 Target: | 5'-GCACTTTGCACTGGAACTTACAACACC-3' (SEQ ID NO: 661) |
|  | 5'-CUGGAACUUACAACACCCGAGCAag-3' (SEQ ID NO: 8) |
|  | 3'-<u>GU</u>GACCUUGAAUGUUGUGGGCUCGU<u>UC</u>-5' (SEQ ID NO: 335) |
| MYC-417 Target: | 5'-CACTGGAACTTACAACACCCGAGCAAG-3' (SEQ ID NO: 662) |
|  | 5'-GCAGCUGCUUAGACGCUGGAUUUtt-3' (SEQ ID NO: 9) |
|  | 3'-<u>AAC</u>GUCGACGAAUCUGCGACCUAAA<u>AA</u>-5' (SEQ ID NO: 336) |
| MYC-535 Target: | 5'-TTGCAGCTGCTTAGACGCTGGATTTTT-3' (SEQ ID NO: 663) |
|  | 5'-GCUUAGACGCUGGAUUUUUUCGgg-3' (SEQ ID NO: 10) |
|  | 3'-<u>GAC</u>GAAUCUGCGACCUAAAAAAGC<u>CC</u>-5' (SEQ ID NO: 337) |
| MYC-541 Target: | 5'-CTGCTTAGACGCTGGATTTTTTCGGG-3' (SEQ ID NO: 664) |
|  | 5'-CGCUGGAUUUUUUCGGGUAGUGga-3' (SEQ ID NO: 11) |
|  | 3'-<u>CUG</u>CGACCUAAAAAAGCCCAUCAC<u>CU</u>-5' (SEQ ID NO: 338) |
| MYC-548 Target: | 5'-GACGCTGGATTTTTTCGGGTAGTGGA-3' (SEQ ID NO: 665) |
|  | 5'-GAUUUUUUCGGGUAGUGGAAAAcc-3' (SEQ ID NO: 12) |
|  | 3'-<u>ACC</u>UAAAAAAGCCCAUCACCUUUU<u>GG</u>-5' (SEQ ID NO: 339) |
| MYC-553 Target: | 5'-TGGATTTTTTCGGGTAGTGGAAAACC-3' (SEQ ID NO: 666) |

TABLE 2-continued

Selected Human Anti-MYC DsiRNA Agents (Asymmetrics)

```
                       5'-CGGGUAGUGGAAAACCAGCAGCCtc-3'    (SEQ ID NO: 13)
                       3'-AAGCCCAUCACCUUUUGGUCGUCGGAG-5'  (SEQ ID NO: 340)
MYC-562  Target:       5'-TTCGGGTAGTGGAAAACCAGCAGCCTC-3'  (SEQ ID NO: 667)

5'-CUCAACGUUAGCUUCACCAACAGGa-3'    (SEQ ID NO: 14)
                       3'-GGGAGUUGCAAUCGAAGUGGUUGUCCU-5'  (SEQ ID NO: 341)
MYC-601  Target:       5'-CCCTCAACGTTAGCTTCACCAACAGGA-3'  (SEQ ID NO: 668)

5'-GUUAGCUUCACCAACAGGAACUAtg-3'    (SEQ ID NO: 15)
                       3'-UGCAAUCGAAGUGGUUGUCCUUGAUAC-5'  (SEQ ID NO: 342)
MYC-607  Target:       5'-ACGTTAGCTTCACCAACAGGAACTATG-3'  (SEQ ID NO: 669)

5'-GACUCGGUGCAGCCGUAUUUCUAct-3'    (SEQ ID NO: 16)
                       3'-UGCUGAGCCACGUCGGCAUAAAGAUGA-5'  (SEQ ID NO: 343)
MYC-643  Target:       5'-ACGACTCGGTGCAGCCGTATTTCTACT-3'  (SEQ ID NO: 670)

5'-GCAGCCGUAUUUCUACUGCGACGag-3'    (SEQ ID NO: 17)
                       3'-CACGUCGGCAUAAAGAUGACGCUGCUC-5'  (SEQ ID NO: 344)
MYC-651  Target:       5'-GTGCAGCCGTATTTCTACTGCGACGAG-3'  (SEQ ID NO: 671)

5'-GAGGAGAACUUCUACCAGCAGCAgc-3'    (SEQ ID NO: 18)
                       3'-UCCUCCUCUUGAAGAUGGUCGUCGUCG-5'  (SEQ ID NO: 345)
MYC-676  Target:       5'-AGGAGGAGAACTTCTACCAGCAGCAGC-3'  (SEQ ID NO: 672)

5'-GCGAGGAUAUCUGGAAGAAAUUCga-3'    (SEQ ID NO: 19)
                       3'-GUCGCUCCUAUAGACCUUCUUUAAGCU-5'  (SEQ ID NO: 346)
MYC-731  Target:       5'-CAGCGAGGATATCTGGAAGAAATTCGA-3'  (SEQ ID NO: 673)

5'-CGUUGCGGUCACACCCUUCUCCCtt-3'    (SEQ ID NO: 20)
                       3'-AUGCAACGCCAGUGUGGGAAGAGGGAA-5'  (SEQ ID NO: 347)
MYC-816  Target:       5'-TACGTTGCGGTCACACCCTTCTCCCTT-3'  (SEQ ID NO: 674)

5'-ACAUGGUGAACCAGAGUUUCAUCtg-3'    (SEQ ID NO: 21)
                       3'-UCUGUACCACUUGGUCUCAAAGUAGAC-5'  (SEQ ID NO: 348)
MYC-920  Target:       5'-AGACATGGTGAACCAGAGTTTCATCTG-3'  (SEQ ID NO: 675)

5'-CCGGACGACGAGACCUUCAUCAAaa-3'    (SEQ ID NO: 22)
                       3'-UGGGCCUGCUGCUCUGGAAGUAGUUUU-5'  (SEQ ID NO: 349)
MYC-949  Target:       5'-ACCCGGACGACGAGACCTTCATCAAAA-3'  (SEQ ID NO: 676)

5'-GAGACCUUCAUCAAAAACAUCAUca-3'    (SEQ ID NO: 23)
                       3'-UGCUCUGGAAGUAGUUUUUGUAGUAGU-5'  (SEQ ID NO: 350)
MYC-958  Target:       5'-ACGAGACCTTCATCAAAAACATCATCA-3'  (SEQ ID NO: 677)

5'-AAAAACAUCAUCAUCCAGGACUGta-3'    (SEQ ID NO: 24)
                       3'-AGUUUUUGUAGUAGUAGGUCCUGACAU-5'  (SEQ ID NO: 351)
MYC-970  Target:       5'-TCAAAAACATCATCATCCAGGACTGTA-3'  (SEQ ID NO: 678)

5'-GGACUGUAUGUGGAGCGGCUUCUcg-3'    (SEQ ID NO: 25)
                       3'-GUCCUGACAUACACCUCGCCGAAGAGC-5'  (SEQ ID NO: 352)
MYC-987  Target:       5'-CAGGACTGTATGTGGAGCGGCTTCTCG-3'  (SEQ ID NO: 679)
```

TABLE 2-continued

Selected Human Anti-MYC DsiRNA Agents (Asymmetrics)

```
                 5'-CUGCUCCACCUCCAGCUUGUACCtg-3'      (SEQ ID NO: 26)

3'-CAGACGAGGUGGAGGUCGAACAUGGAC-5'    (SEQ ID NO: 353)

MYC-1104 Target: 5'-GTCTGCTCCACCTCCAGCTTGTACCTG-3'    (SEQ ID NO: 680)

5'-ACCUCCAGCUUGUACCUGCAGGAtc-3'      (SEQ ID NO: 27)

3'-GGUGGAGGUCGAACAUGGACGUCCUAG-5'    (SEQ ID NO: 354)

MYC-1111 Target: 5'-CCACCTCCAGCTTGTACCTGCAGGATC-3'    (SEQ ID NO: 681)

5'-CAGCUUGUACCUGCAGGAUCUGAgc-3'      (SEQ ID NO: 28)

3'-AGGUCGAACAUGGACGUCCUAGACUCG-5'    (SEQ ID NO: 355)

MYC-1116 Target: 5'-TCCAGCTTGTACCTGCAGGATCTGAGC-3'    (SEQ ID NO: 682)

5'-AAGUCCUGCGCCUCGCAAGACUCca-3'      (SEQ ID NO: 29)

3'-GGUUCAGGACGCGGAGCGUUCUGAGGU-5'    (SEQ ID NO: 356)

MYC-1210 Target: 5'-CCAAGTCCTGCGCCTCGCAAGACTCCA-3'    (SEQ ID NO: 683)

5'-GCAGCGACUCUGAGGAGGAACAAga-3'      (SEQ ID NO: 30)

3'-GUCGUCGCUGAGACUCCUCCUUGUUCU-5'    (SEQ ID NO: 357)

MYC-1340 Target: 5'-CAGCAGCGACTCTGAGGAGGAACAAGA-3'    (SEQ ID NO: 684)

5'-ACUCUGAGGAGGAACAAGAAGAUga-3'      (SEQ ID NO: 31)

3'-GCUGAGACUCCUCCUUGUUCUUCUACU-5'    (SEQ ID NO: 358)

MYC-1346 Target: 5'-CGACTCTGAGGAGGAACAAGAAGATGA-3'    (SEQ ID NO: 685)

5'-GAGGAGGAACAAGAAGAUGAGGAag-3'      (SEQ ID NO: 32)

3'-GACUCCUCCUUGUUCUUCUACUCCUUC-5'    (SEQ ID NO: 359)

MYC-1351 Target: 5'-CTGAGGAGGAACAAGAAGATGAGGAAG-3'    (SEQ ID NO: 686)

5'-AACAAGAAGAUGAGGAAGAAAUCga-3'      (SEQ ID NO: 33)

3'-CCUUGUUCUUCUACUCCUUCUUUAGCU-5'    (SEQ ID NO: 360)

MYC-1358 Target: 5'-GGAACAAGAAGATGAGGAAGAAATCGA-3'    (SEQ ID NO: 687)

5'-AAGAUGAGGAAGAAAUCGAUGUUgt-3'      (SEQ ID NO: 34)

3'-UCUUCUACUCCUUCUUUAGCUACAACA-5'    (SEQ ID NO: 361)

MYC-1364 Target: 5'-AGAAGATGAGGAAGAAATCGATGTTGT-3'    (SEQ ID NO: 688)

5'-AGGAAGAAAUCGAUGUUGUUUCUgt-3'      (SEQ ID NO: 35)

3'-ACUCCUUCUUUAGCUACAACAAAGACA-5'    (SEQ ID NO: 362)

MYC-1370 Target: 5'-TGAGGAAGAAATCGATGTTGTTTCTGT-3'    (SEQ ID NO: 689)

5'-AAAUCGAUGUUGUUUCUGUGGAAaa-3'      (SEQ ID NO: 36)

3'-UCUUUAGCUACAACAAAGACACCUUUU-5'    (SEQ ID NO: 363)

MYC-1376 Target: 5'-AGAAATCGATGTTGTTTCTGTGGAAAA-3'    (SEQ ID NO: 690)

5'-AUGUUGUUUCUGUGGAAAAGAGGca-3'      (SEQ ID NO: 37)

3'-GCUACAACAAAGACACCUUUUCUCCGU-5'    (SEQ ID NO: 364)

MYC-1382 Target: 5'-CGATGTTGTTTCTGTGGAAAAGAGGCA-3'    (SEQ ID NO: 691)

5'-GAGGCAGGCUCCUGGCAAAAGGUca-3'      (SEQ ID NO: 38)

3'-UUCUCCGUCCGAGGACCGUUUUCCAGU-5'    (SEQ ID NO: 365)

MYC-1401 Target: 5'-AAGAGGCAGGCTCCTGGCAAAAGGTCA-3'    (SEQ ID NO: 692)
```

TABLE 2-continued

Selected Human Anti-MYC DsiRNA Agents (Asymmetrics)

```
                 5'-AGGCUCCUGGCAAAAGGUCAGAGtc-3'      (SEQ ID NO: 39)
                 3'-CGUCCGAGGACCGUUUUCCAGUCUCAG-5'    (SEQ ID NO: 366)
MYC-1406 Target: 5'-GCAGGCTCCTGGCAAAAGGTCAGAGTC-3'    (SEQ ID NO: 693)

5'-CCUGGCAAAAGGUCAGAGUCUGGat-3'      (SEQ ID NO: 40)
                 3'-GAGGACCGUUUUCCAGUCUCAGACCUA-5'    (SEQ ID NO: 367)
MYC-1411 Target: 5'-CTCCTGGCAAAAGGTCAGAGTCTGGAT-3'    (SEQ ID NO: 694)

5'-CAAAAGGUCAGAGUCUGGAUCACct-3'      (SEQ ID NO: 41)
                 3'-CCGUUUUCCAGUCUCAGACCUAGUGGA-5'    (SEQ ID NO: 368)
MYC-1416 Target: 5'-GGCAAAAGGTCAGAGTCTGGATCACCT-3'    (SEQ ID NO: 695)

5'-GGUCAGAGUCUGGAUCACCUUCUgc-3'      (SEQ ID NO: 42)
                 3'-UUCCAGUCUCAGACCUAGUGGAAGACG-5'    (SEQ ID NO: 369)
MYC-1421 Target: 5'-AAGGTCAGAGTCTGGATCACCTTCTGC-3'    (SEQ ID NO: 696)

5'-GCAAACCUCCUCACAGCCCACUGgt-3'      (SEQ ID NO: 43)
                 3'-GUCGUUUGGAGGAGUGUCGGGUGACCA-5'    (SEQ ID NO: 370)
MYC-1457 Target: 5'-CAGCAAACCTCCTCACAGCCCACTGGT-3'    (SEQ ID NO: 697)

5'-CCUCACAGCCCACUGGUCCUCAAga-3'      (SEQ ID NO: 44)
                 3'-GAGGAGUGUCGGGUGACCAGGAGUUCU-5'    (SEQ ID NO: 371)
MYC-1465 Target: 5'-CTCCTCACAGCCCACTGGTCCTCAAGA-3'    (SEQ ID NO: 698)

5'-CCCUCCACUCGGAAGGACUAUCCtg-3'      (SEQ ID NO: 45)
                 3'-GAGGGAGGUGAGCCUUCCUGAUAGGAC-5'    (SEQ ID NO: 372)
MYC-1531 Target: 5'-CTCCCTCCACTCGGAAGGACTATCCTG-3'    (SEQ ID NO: 699)

5'-CUCGGAAGGACUAUCCUGCUGCCaa-3'      (SEQ ID NO: 46)
                 3'-GUGAGCCUUCCUGAUAGGACGACGGUU-5'    (SEQ ID NO: 373)
MYC-1538 Target: 5'-CACTCGGAAGGACTATCCTGCTGCCAA-3'    (SEQ ID NO: 700)

5'-AUCCUGCUGCCAAGAGGGUCAAGtt-3'      (SEQ ID NO: 47)
                 3'-GAUAGGACGACGGUUCUCCCAGUUCAA-5'    (SEQ ID NO: 374)
MYC-1550 Target: 5'-CTATCCTGCTGCCAAGAGGGTCAAGTT-3'    (SEQ ID NO: 701)

5'-GCUGCCAAGAGGGUCAAGUUGGAca-3'      (SEQ ID NO: 48)
                 3'-GACGACGGUUCUCCCAGUUCAACCUGU-5'    (SEQ ID NO: 375)
MYC-1555 Target: 5'-CTGCTGCCAAGAGGGTCAAGTTGGACA-3'    (SEQ ID NO: 702)

5'-CAAGAGGGUCAAGUUGGACAGUGtc-3'      (SEQ ID NO: 49)
                 3'-CGGUUCUCCCAGUUCAACCUGUCACAG-5'    (SEQ ID NO: 376)
MYC-1560 Target: 5'-GCCAAGAGGGTCAAGTTGGACAGTGTC-3'    (SEQ ID NO: 703)

5'-GGGUCAAGUUGGACAGUGUCAGAgt-3'      (SEQ ID NO: 50)
                 3'-CUCCCAGUUCAACCUGUCACAGUCUCA-5'    (SEQ ID NO: 377)
MYC-1565 Target: 5'-GAGGGTCAAGTTGGACAGTGTCAGAGT-3'    (SEQ ID NO: 704)

5'-AAGUUGGACAGUGUCAGAGUCCUga-3'      (SEQ ID NO: 51)
                 3'-AGUUCAACCUGUCACAGUCUCAGGACU-5'    (SEQ ID NO: 378)
MYC-1570 Target: 5'-TCAAGTTGGACAGTGTCAGAGTCCTGA-3'    (SEQ ID NO: 705)
```

TABLE 2-continued

Selected Human Anti-MYC DsiRNA Agents (Asymmetrics)

```
                5'-GGACAGUGUCAGAGUCCUGAGACag-3'  (SEQ ID NO: 52)

3'-AACCUGUCACAGUCUCAGGACUCUGUC-5' (SEQ ID NO: 379)

MYC-1575 Target: 5'-TTGGACAGTGTCAGAGTCCTGAGACAG-3' (SEQ ID NO: 706)

5'-CAGAGUCCUGAGACAGAUCAGCAac-3'  (SEQ ID NO: 53)

3'-CAGUCUCAGGACUCUGUCUAGUCGUUG-5' (SEQ ID NO: 380)

MYC-1584 Target: 5'-GTCAGAGTCCTGAGACAGATCAGCAAC-3' (SEQ ID NO: 707)

5'-GAGACAGAUCAGCAACAACCGAAaa-3'  (SEQ ID NO: 54)

3'-GACUCUGUCUAGUCGUUGUUGGCUUUU-5' (SEQ ID NO: 381)

MYC-1593 Target: 5'-CTGAGACAGATCAGCAACAACCGAAAA-3' (SEQ ID NO: 708)

5'-GAUCAGCAACAACCGAAAAUGCAcc-3'  (SEQ ID NO: 55)

3'-GUCUAGUCGUUGUUGGCUUUUACGUGG-5' (SEQ ID NO: 382)

MYC-1599 Target: 5'-CAGATCAGCAACAACCGAAAATGCACC-3' (SEQ ID NO: 709)

5'-CCUCGGACACCGAGGAGAAUGUCaa-3'  (SEQ ID NO: 56)

3'-CAGGAGCCUGUGGCUCCUCUUACAGUU-5' (SEQ ID NO: 383)

MYC-1634 Target: 5'-GTCCTCGGACACCGAGGAGAATGTCAA-3' (SEQ ID NO: 710)

5'-GACACCGAGGAGAAUGUCAAGAGgc-3'  (SEQ ID NO: 57)

3'-GCCUGUGGCUCCUCUUACAGUUCUCCG-5' (SEQ ID NO: 384)

MYC-1639 Target: 5'-CGGACACCGAGGAGAATGTCAAGAGGC-3' (SEQ ID NO: 711)

5'-CAGAGGAGGAACGAGCUAAAACGga-3'  (SEQ ID NO: 58)

3'-CGGUCUCCUCCUUGCUCGAUUUUGCCU-5' (SEQ ID NO: 385)

MYC-1687 Target: 5'-GCCAGAGGAGGAACGAGCTAAAACGGA-3' (SEQ ID NO: 712)

5'-AGGAACGAGCUAAAACGGAGCUUtt-3'  (SEQ ID NO: 59)

3'-CCUCCUUGCUCGAUUUUGCCUCGAAAA-5' (SEQ ID NO: 386)

MYC-1693 Target: 5'-GGAGGAACGAGCTAAAACGGAGCTTTT-3' (SEQ ID NO: 713)

5'-CGAGCUAAAACGGAGCUUUUUUGcc-3'  (SEQ ID NO: 60)

3'-UUGCUCGAUUUUGCCUCGAAAAAACGG-5' (SEQ ID NO: 387)

MYC-1698 Target: 5'-AACGAGCTAAAACGGAGCTTTTTTGCC-3' (SEQ ID NO: 714)

5'-AAAACGGAGCUUUUUUGCCCUGCgt-3'  (SEQ ID NO: 61)

3'-GAUUUUGCCUCGAAAAAACGGGACGCA-5' (SEQ ID NO: 388)

MYC-1704 Target: 5'-CTAAAACGGAGCTTTTTTGCCCTGCGT-3' (SEQ ID NO: 715)

5'-GGAGCUUUUUUGCCCUGCGUGACca-3'  (SEQ ID NO: 62)

3'-UGCCUCGAAAAAACGGGACGCACUGGU-5' (SEQ ID NO: 389)

MYC-1709 Target: 5'-ACGGAGCTTTTTTGCCCTGCGTGACCA-3' (SEQ ID NO: 716)

5'-GACCAGAUCCCGGAGUUGGAAAAca-3'  (SEQ ID NO: 63)

3'-CACUGGUCUAGGGCCUCAACCUUUUGU-5' (SEQ ID NO: 390)

MYC-1729 Target: 5'-GTGACCAGATCCCGGAGTTGGAAAACA-3' (SEQ ID NO: 717)

5'-GAUCCCGGAGUUGGAAAACAAUGaa-3'  (SEQ ID NO: 64)

3'-GUCUAGGGCCUCAACCUUUUGUUACUU-5' (SEQ ID NO: 391)

MYC-1734 Target: 5'-CAGATCCCGGAGTTGGAAAACAATGAA-3' (SEQ ID NO: 718)
```

TABLE 2-continued

Selected Human Anti-MYC DsiRNA Agents (Asymmetrics)

```
                 5'-CGGAGUUGGAAAACAAUGAAAAGgc-3'    (SEQ ID NO: 65)
                 3'-GGGCCUCAACCUUUUGUUACUUUUCCG-5'  (SEQ ID NO: 392)
MYC-1739 Target: 5'-CCCGGAGTTGGAAAACAATGAAAAGGC-3'  (SEQ ID NO: 719)

5'-AGGUAGUUAUCCUUAAAAAAGCCac-3'    (SEQ ID NO: 66)
                 3'-GUUCCAUCAAUAGGAAUUUUUUCGGUG-5'  (SEQ ID NO: 393)
MYC-1769 Target: 5'-CAAGGTAGTTATCCTTAAAAAAGCCAC-3'  (SEQ ID NO: 720)

5'-GUUAUCCUUAAAAAAGCCACAGCat-3'    (SEQ ID NO: 67)
                 3'-AUCAAUAGGAAUUUUUUCGGUGUCGUA-5'  (SEQ ID NO: 394)
MYC-1774 Target: 5'-TAGTTATCCTTAAAAAGCCACAGCAT-3'   (SEQ ID NO: 721)

5'-CCUUAAAAAAGCCACAGCAUACAtc-3'    (SEQ ID NO: 68)
                 3'-UAGGAAUUUUUUCGGUGUCGUAUGUAG-5'  (SEQ ID NO: 395)
MYC-1779 Target: 5'-ATCCTTAAAAAGCCACAGCATACATC-3'   (SEQ ID NO: 722)

5'-AAAAAGCCACAGCAUACAUCCUGtc-3'    (SEQ ID NO: 69)
                 3'-AUUUUUUCGGUGUCGUAUGUAGGACAG-5'  (SEQ ID NO: 396)
MYC-1784 Target: 5'-TAAAAAGCCACAGCATACATCCTGTC-3'   (SEQ ID NO: 723)

5'-GCCACAGCAUACAUCCUGUCCGUcc-3'    (SEQ ID NO: 70)
                 3'-UUCGGUGUCGUAUGUAGGACAGGCAGG-5'  (SEQ ID NO: 397)
MYC-1789 Target: 5'-AAGCCACAGCATACATCCTGTCCGTCC-3'  (SEQ ID NO: 724)

5'-GCAUACAUCCUGUCCGUCCAAGCag-3'    (SEQ ID NO: 71)
                 3'-GUCGUAUGUAGGACAGGCAGGUUCGUC-5'  (SEQ ID NO: 398)
MYC-1795 Target: 5'-CAGCATACATCCTGTCCGTCCAAGCAG-3'  (SEQ ID NO: 725)

5'-CCUGUCCGUCCAAGCAGAGGAGCaa-3'    (SEQ ID NO: 72)
                 3'-UAGGACAGGCAGGUUCGUCUCCUCGUU-5'  (SEQ ID NO: 399)
MYC-1803 Target: 5'-ATCCTGTCCGTCCAAGCAGAGGAGCAA-3'  (SEQ ID NO: 726)

5'-CCGUCCAAGCAGAGGAGCAAAAGct-3'    (SEQ ID NO: 73)
                 3'-CAGGCAGGUUCGUCUCCUCGUUUUCGA-5'  (SEQ ID NO: 400)
MYC-1808 Target: 5'-GTCCGTCCAAGCAGAGGAGCAAAAGCT-3'  (SEQ ID NO: 727)

5'-GCAGAGGAGCAAAAGCUCAUUUCtg-3'    (SEQ ID NO: 74)
                 3'-UUCGUCUCCUCGUUUUCGAGUAAAGAC-5'  (SEQ ID NO: 401)
MYC-1816 Target: 5'-AAGCAGAGGAGCAAAAGCTCATTTCTG-3'  (SEQ ID NO: 728)

5'-AGCAAAAGCUCAUUUCUGAAGAGga-3'    (SEQ ID NO: 75)
                 3'-CCUCGUUUUCGAGUAAAGACUUCUCCU-5'  (SEQ ID NO: 402)
MYC-1823 Target: 5'-GGAGCAAAAGCTCATTTCTGAAGAGGA-3'  (SEQ ID NO: 729)

5'-AAGCUCAUUUCUGAAGAGGACUUgt-3'    (SEQ ID NO: 76)
                 3'-UUUUCGAGUAAAGACUUCUCCUGAACA-5'  (SEQ ID NO: 403)
MYC-1828 Target: 5'-AAAAGCTCATTTCTGAAGAGGACTTGT-3'  (SEQ ID NO: 730)

5'-AUUUCUGAAGAGGACUUGUUGCGga-3'    (SEQ ID NO: 77)
                 3'-AGUAAAGACUUCUCCUGAACAACGCCU-5'  (SEQ ID NO: 404)
MYC-1834 Target: 5'-TCATTTCTGAAGAGGACTTGTTGCGGA-3'  (SEQ ID NO: 731)
```

TABLE 2-continued

Selected Human Anti-MYC DsiRNA Agents (Asymmetrics)

```
                    5'-GAAGAGGACUUGUUGCGGAAACGac-3'    (SEQ ID NO: 78)
                    3'-GACUUCUCCUGAACAACGCCUUUGCUG-5'  (SEQ ID NO: 405)
MYC-1840 Target:    5'-CTGAAGAGGACTTGTTGCGGAAACGAC-3'  (SEQ ID NO: 732)

5'-GGACUUGUUGCGGAAACGACGAGaa-3'    (SEQ ID NO: 79)
                    3'-CUCCUGAACAACGCCUUUGCUGCUCUU-5'  (SEQ ID NO: 406)
MYC-1845 Target:    5'-GAGGACTTGTTGCGGAAACGACGAGAA-3'  (SEQ ID NO: 733)

5'-UGUUGCGGAAACGACGAGAACAGtt-3'    (SEQ ID NO: 80)
                    3'-GAACAACGCCUUUGCUGCUCUUGUCAA-5'  (SEQ ID NO: 407)
MYC-1850 Target:    5'-CTTGTTGCGGAAACGACGAGAACAGTT-3'  (SEQ ID NO: 734)

5'-CGGAAACGACGAGAACAGUUGAAac-3'    (SEQ ID NO: 81)
                    3'-ACGCCUUUGCUGCUCUUGUCAACUUUG-5'  (SEQ ID NO: 408)
MYC-1855 Target:    5'-TGCGGAAACGACGAGAACAGTTGAAAC-3'  (SEQ ID NO: 735)

5'-AAACUUGAACAGCUACGGAACUCtt-3'    (SEQ ID NO: 82)
                    3'-UGUUUGAACUUGUCGAUGCCUUGAGAA-5'  (SEQ ID NO: 409)
MYC-1882 Target:    5'-ACAAACTTGAACAGCTACGGAACTCTT-3'  (SEQ ID NO: 736)

5'-GAACAGCUACGGAACUCUUGUGCgt-3'    (SEQ ID NO: 83)
                    3'-AACUUGUCGAUGCCUUGAGAACACGCA-5'  (SEQ ID NO: 410)
MYC-1888 Target:    5'-TTGAACAGCTACGGAACTCTTGTGCGT-3'  (SEQ ID NO: 737)

5'-GCUACGGAACUCUUGUGCGUAAGga-3'    (SEQ ID NO: 84)
                    3'-GUCGAUGCCUUGAGAACACGCAUUCCU-5'  (SEQ ID NO: 411)
MYC-1893 Target:    5'-CAGCTACGGAACTCTTGTGCGTAAGGA-3'  (SEQ ID NO: 738)

5'-AACUCUUGUGCGUAAGGAAAAGUaa-3'    (SEQ ID NO: 85)
                    3'-CCUUGAGAACACGCAUUCCUUUUCAUU-5'  (SEQ ID NO: 412)
MYC-1900 Target:    5'-GGAACTCTTGTGCGTAAGGAAAAGTAA-3'  (SEQ ID NO: 739)

5'-UGUGCGUAAGGAAAAGUAAGGAAaa-3'    (SEQ ID NO: 86)
                    3'-GAACACGCAUUCCUUUUCAUUCCUUUU-5'  (SEQ ID NO: 413)
MYC-1906 Target:    5'-CTTGTGCGTAAGGAAAAGTAAGGAAAA-3'  (SEQ ID NO: 740)

5'-GUAAGGAAAAGUAAGGAAAACGAtt-3'    (SEQ ID NO: 87)
                    3'-CGCAUUCCUUUUCAUUCCUUUUGCUAA-5'  (SEQ ID NO: 414)
MYC-1911 Target:    5'-GCGTAAGGAAAAGTAAGGAAAACGATT-3'  (SEQ ID NO: 741)

5'-GUAAGGAAAACGAUUCCUUCUAAca-3'    (SEQ ID NO: 88)
                    3'-UUCAUUCCUUUUGCUAAGGAAGAUUGU-5'  (SEQ ID NO: 415)
MYC-1921 Target:    5'-AAGTAAGGAAAACGATTCCTTCTAACA-3'  (SEQ ID NO: 742)

5'-GAAAACGAUUCCUUCUAACAGAAat-3'    (SEQ ID NO: 89)
                    3'-UCCUUUUGCUAAGGAAGAUUGUCUUUA-5'  (SEQ ID NO: 416)
MYC-1926 Target:    5'-AGGAAAACGATTCCTTCTAACAGAAAT-3'  (SEQ ID NO: 743)

5'-CGAUUCCUUCUAACAGAAAUGUCct-3'    (SEQ ID NO: 90)
                    3'-UUGCUAAGGAAGAUUGUCUUUACAGGA-5'  (SEQ ID NO: 417)
MYC-1931 Target:    5'-AACGATTCCTTCTAACAGAAATGTCCT-3'  (SEQ ID NO: 744)
```

TABLE 2-continued

Selected Human Anti-MYC DsiRNA Agents (Asymmetrics)

```
                        5'-CUUCUAACAGAAAUGUCCUGAGCaa-3'   (SEQ ID NO: 91)

3'-AGGAAGAUUGUCUUUACAGGACUCGUU-5' (SEQ ID NO: 418)

MYC-1937 Target: 5'-TCCTTCTAACAGAAATGTCCTGAGCAA-3' (SEQ ID NO: 745)

5'-CAGAAAUGUCCUGAGCAAUCACCta-3'   (SEQ ID NO: 92)

3'-UUGUCUUUACAGGACUCGUUAGUGGAU-5' (SEQ ID NO: 419)

MYC-1944 Target: 5'-AACAGAAATGTCCTGAGCAATCACCTA-3' (SEQ ID NO: 746)

5'-CCUGAGCAAUCACCUAUGAACUUgt-3'   (SEQ ID NO: 93)

3'-CAGGACUCGUUAGUGGAUACUUGAACA-5' (SEQ ID NO: 420)

MYC-1953 Target: 5'-GTCCTGAGCAATCACCTATGAACTTGT-3' (SEQ ID NO: 747)

5'-CAAUCACCUAUGAACUUGUUUCAaa-3'   (SEQ ID NO: 94)

3'-UCGUUAGUGGAUACUUGAACAAAGUUU-5' (SEQ ID NO: 421)

MYC-1959 Target: 5'-AGCAATCACCTATGAACTTGTTTCAAA-3' (SEQ ID NO: 748)

5'-CCUAUGAACUUGUUUCAAAUGCAtg-3'   (SEQ ID NO: 95)

3'-GUGGAUACUUGAACAAAGUUUACGUAC-5' (SEQ ID NO: 422)

MYC-1965 Target: 5'-CACCTATGAACTTGTTTCAAATGCATG-3' (SEQ ID NO: 749)

5'-GAACUUGUUUCAAAUGCAUGAUCaa-3'   (SEQ ID NO: 96)

3'-UACUUGAACAAAGUUUACGUACUAGUU-5' (SEQ ID NO: 423)

MYC-1970 Target: 5'-ATGAACTTGTTTCAAATGCATGATCAA-3' (SEQ ID NO: 750)

5'-GUUUCAAAUGCAUGAUCAAAUGCaa-3'   (SEQ ID NO: 97)

3'-AACAAAGUUUACGUACUAGUUUACGUU-5' (SEQ ID NO: 424)

MYC-1976 Target: 5'-TTGTTTCAAATGCATGATCAAATGCAA-3' (SEQ ID NO: 751)

5'-AAAUGCAUGAUCAAAUGCAACCUca-3'   (SEQ ID NO: 98)

3'-AGUUUACGUACUAGUUUACGUUGGAGU-5' (SEQ ID NO: 425)

MYC-1981 Target: 5'-TCAAATGCATGATCAAATGCAACCTCA-3' (SEQ ID NO: 752)

5'-GAUCAAAUGCAACCUCACAACCUtg-3'   (SEQ ID NO: 99)

3'-UACUAGUUUACGUUGGAGUGUUGGAAC-5' (SEQ ID NO: 426)

MYC-1989 Target: 5'-ATGATCAAATGCAACCTCACAACCTTG-3' (SEQ ID NO: 753)

5'-AAUGCAACCUCACAACCUUGGCUga-3'   (SEQ ID NO: 100)

3'-GUUUACGUUGGAGUGUUGGAACCGACU-5' (SEQ ID NO: 427)

MYC-1994 Target: 5'-CAAATGCAACCTCACAACCTTGGCTGA-3' (SEQ ID NO: 754)

5'-CCUCACAACCUUGGCUGAGUCUUga-3'   (SEQ ID NO: 101)

3'-UUGGAGUGUUGGAACCGACUCAGAACU-5' (SEQ ID NO: 428)

MYC-2001 Target: 5'-AACCTCACAACCTTGGCTGAGTCTTGA-3' (SEQ ID NO: 755)

5'-CAACCUUGGCUGAGUCUUGAGACtg-3'   (SEQ ID NO: 102)

3'-GUGUUGGAACCGACUCAGAACUCUGAC-5' (SEQ ID NO: 429)

MYC-2006 Target: 5'-CACAACCTTGGCTGAGTCTTGAGACTG-3' (SEQ ID NO: 756)

5'-GGCUGAGUCUUGAGACUGAAAGAtt-3'   (SEQ ID NO: 103)

3'-AACCGACUCAGAACUCUGACUUUCUAA-5' (SEQ ID NO: 430)

MYC-2013 Target: 5'-TTGGCTGAGTCTTGAGACTGAAAGATT-3' (SEQ ID NO: 757)
```

TABLE 2-continued

Selected Human Anti-MYC DsiRNA Agents (Asymmetrics)

|  |  |  |
|---|---|---|
|  | 5'-GUCUUGAGACUGAAAGAUUUAGCca-3' | (SEQ ID NO: 104) |
|  | 3'-CUCAGAACUCUGACUUUCUAAAUCGGU-5' | (SEQ ID NO: 431) |
| MYC-2019 Target: | 5'-GAGTCTTGAGACTGAAAGATTTAGCCA-3' | (SEQ ID NO: 758) |
|  | 5'-GACUGAAAGAUUUAGCCAUAAUGta-3' | (SEQ ID NO: 105) |
|  | 3'-CUCUGACUUUCUAAAUCGGUAUUACAU-5' | (SEQ ID NO: 432) |
| MYC-2026 Target: | 5'-GAGACTGAAAGATTTAGCCATAATGTA-3' | (SEQ ID NO: 759) |
|  | 5'-AAAGAUUUAGCCAUAAUGUAAACtg-3' | (SEQ ID NO: 106) |
|  | 3'-ACUUUCUAAAUCGGUAUUACAUUUGAC-5' | (SEQ ID NO: 433) |
| MYC-2031 Target: | 5'-TGAAAGATTTAGCCATAATGTAAACTG-3' | (SEQ ID NO: 760) |
|  | 5'-GCCAUAAUGUAAACUGCCUCAAAtt-3' | (SEQ ID NO: 107) |
|  | 3'-AUCGGUAUUACAUUUGACGGAGUUUAA-5' | (SEQ ID NO: 434) |
| MYC-2040 Target: | 5'-TAGCCATAATGTAAACTGCCTCAAATT-3' | (SEQ ID NO: 761) |
|  | 5'-GUAAACUGCCUCAAAUUGGACUUtg-3' | (SEQ ID NO: 108) |
|  | 3'-UACAUUUGACGGAGUUUAACCUGAAAC-5' | (SEQ ID NO: 435) |
| MYC-2048 Target: | 5'-ATGTAAACTGCCTCAAATTGGACTTTG-3' | (SEQ ID NO: 762) |
|  | 5'-UGCCUCAAAUUGGACUUUGGGCAta-3' | (SEQ ID NO: 109) |
|  | 3'-UGACGGAGUUUAACCUGAAACCCGUAU-5' | (SEQ ID NO: 436) |
| MYC-2054 Target: | 5'-ACTGCCTCAAATTGGACTTTGGGCATA-3' | (SEQ ID NO: 763) |
|  | 5'-CAAAUUGGACUUUGGGCAUAAAAga-3' | (SEQ ID NO: 110) |
|  | 3'-GAGUUUAACCUGAAACCCGUAUUUUCU-5' | (SEQ ID NO: 437) |
| MYC-2059 Target: | 5'-CTCAAATTGGACTTTGGGCATAAAAGA-3' | (SEQ ID NO: 764) |
|  | 5'-GACUUUGGGCAUAAAAGAACUUUtt-3' | (SEQ ID NO: 111) |
|  | 3'-ACCUGAAACCCGUAUUUUCUUGAAAAA-5' | (SEQ ID NO: 438) |
| MYC-2066 Target: | 5'-TGGACTTTGGGCATAAAAGAACTTTTT-3' | (SEQ ID NO: 765) |
|  | 5'-GGCAUAAAAGAACUUUUUUAUGCtt-3' | (SEQ ID NO: 112) |
|  | 3'-ACCCGUAUUUUCUUGAAAAAAUACGAA-5' | (SEQ ID NO: 439) |
| MYC-2073 Target: | 5'-TGGGCATAAAAGAACTTTTTTATGCTT-3' | (SEQ ID NO: 766) |
|  | 5'-AAAAGAACUUUUUUAUGCUUACCat-3' | (SEQ ID NO: 113) |
|  | 3'-UAUUUUCUUGAAAAAAUACGAAUGGUA-5' | (SEQ ID NO: 440) |
| MYC-2078 Target: | 5'-ATAAAAGAACTTTTTTATGCTTACCAT-3' | (SEQ ID NO: 767) |
|  | 5'-AACUUUUUUAUGCUUACCAUCUUtt-3' | (SEQ ID NO: 114) |
|  | 3'-UCUUGAAAAAAUACGAAUGGUAGAAAA-5' | (SEQ ID NO: 441) |
| MYC-2083 Target: | 5'-AGAACTTTTTTATGCTTACCATCTTTT-3' | (SEQ ID NO: 768) |
|  | 5'-UUUAUGCUUACCAUCUUUUUUUUtt-3' | (SEQ ID NO: 115) |
|  | 3'-AAAAAUACGAAUGGUAGAAAAAAAAAA-5' | (SEQ ID NO: 442) |
| MYC-2089 Target: | 5'-TTTTTATGCTTACCATCTTTTTTTTTT-3' | (SEQ ID NO: 769) |
|  | 5'-GCUUACCAUCUUUUUUUUUCUUta-3' | (SEQ ID NO: 116) |
|  | 3'-UACGAAUGGUAGAAAAAAAAAGAAAU-5' | (SEQ ID NO: 443) |
| MYC-2094 Target: | 5'-ATGCTTACCATCTTTTTTTTTCTTTA-3' | (SEQ ID NO: 770) |

TABLE 2-continued

Selected Human Anti-MYC DsiRNA Agents (Asymmetrics)

```
                5'-CCAUCUUUUUUUUUCUUUAACAga-3'     (SEQ ID NO: 117)
                3'-AUGGUAGAAAAAAAAAGAAAUUGUCU-5'   (SEQ ID NO: 444)
MYC-2099 Target: 5'-TACCATCTTTTTTTTTCTTTAACAGA-3'  (SEQ ID NO: 771)
                5'-UUUUUUUUCUUUAACAGAUUUGta-3'    (SEQ ID NO: 118)
                3'-GAAAAAAAAAGAAAUUGUCUAAACAU-5'   (SEQ ID NO: 445)
MYC-2105 Target: 5'-CTTTTTTTTTCTTTAACAGATTTGTA-3'  (SEQ ID NO: 772)
                5'-CUUUAACAGAUUUGUAUUUAAGAat-3'    (SEQ ID NO: 119)
                3'-AAGAAAUUGUCUAAACAUAAAUUCUUA-5'  (SEQ ID NO: 446)
MYC-2114 Target: 5'-TTCTTTAACAGATTTGTATTTAAGAAT-3' (SEQ ID NO: 773)
                5'-CAGAUUUGUAUUUAAGAAUUGUUtt-3'    (SEQ ID NO: 120)
                3'-UUGUCUAAACAUAAAUUCUUAACAAAA-5'  (SEQ ID NO: 447)
MYC-2120 Target: 5'-AACAGATTTGTATTTAAGAATTGTTTT-3' (SEQ ID NO: 774)
                5'-UAUUUAAGAAUUGUUUUAAAAAat-3'     (SEQ ID NO: 121)
                3'-ACAUAAAUUCUUAACAAAAUUUUUUA-5'   (SEQ ID NO: 448)
MYC-2128 Target: 5'-TGTATTTAAGAATTGTTTTAAAAAAT-3'  (SEQ ID NO: 775)
                5'-GAAUUGUUUUAAAAAAUUUUAAga-3'    (SEQ ID NO: 122)
                3'-UUCUUAACAAAAUUUUUUAAAAUUCU-5'   (SEQ ID NO: 449)
MYC-2135 Target: 5'-AAGAATTGTTTTTAAAAAATTTTAAGA-3' (SEQ ID NO: 776)
                5'-AAUGUUUCUCUGUAAAUAUUGCCat-3'    (SEQ ID NO: 123)
                3'-UGUUACAAAGAGACAUUUAUAACGGUA-5'  (SEQ ID NO: 450)
MYC-2167 Target: 5'-ACAATGTTTCTCTGTAAATATTGCCAT-3' (SEQ ID NO: 777)
                5'-CUGUAAAUAUUGCCAUUAAAUGUaa-3'    (SEQ ID NO: 124)
                3'-GAGACAUUUAUAACGGUAAUUUACAUU-5'  (SEQ ID NO: 451)
MYC-2176 Target: 5'-CTCTGTAAATATTGCCATTAAATGTAA-3' (SEQ ID NO: 778)
                5'-AAUAUUGCCAUUAAAUGUAAAUAac-3'    (SEQ ID NO: 125)
                3'-AUUUAUAACGGUAAUUUACAUUUAUUG-5'  (SEQ ID NO: 452)
MYC-2181 Target: 5'-TAAATATTGCCATTAAATGTAAATAAC-3' (SEQ ID NO: 779)
                5'-CCAUUAAAUGUAAAUAACUUUAAta-3'    (SEQ ID NO: 126)
                3'-ACGGUAAUUUACAUUUAUUGAAAUUAU-5'  (SEQ ID NO: 453)
MYC-2188 Target: 5'-TGCCATTAAATGTAAATAACTTTAATA-3' (SEQ ID NO: 780)
                5'-UUAAUAAACGUUUAUAGCAGUUac-3'     (SEQ ID NO: 127)
                3'-GAAAUUAUUUGCAAAUAUCGUCAAUG-5'   (SEQ ID NO: 454)
MYC-2207 Target: 5'-CTTTAATAAACGTTTATAGCAGTTAC-3'  (SEQ ID NO: 781)
                5'-CAGAAUUUCAAUCCUAGUAUAUAgt-3'    (SEQ ID NO: 128)
                3'-GUGUCUUAAAGUUAGGAUCAUAUAUCA-5'  (SEQ ID NO: 455)
MYC-2233 Target: 5'-CACAGAATTTCAATCCTAGTATATAGT-3' (SEQ ID NO: 782)
                5'-CUAGUAUUAUAGGUACUAUAAACcc-3'    (SEQ ID NO: 129)
                3'-UGGAUCAUAAUAUCCAUGAUAUUUGGG-5'  (SEQ ID NO: 456)
MYC-2260 Target: 5'-ACCTAGTATTATAGGTACTATAAACCC-3' (SEQ ID NO: 783)
```

TABLE 2-continued

Selected Human Anti-MYC DsiRNA Agents (Asymmetrics)

```
                  5'-UAUAGGUACUAUAAACCCUAAUUtt-3'    (SEQ ID NO: 130)
                  3'-UAAUAUCCAUGAUAUUUGGGAUUAAAA-5'  (SEQ ID NO: 457)
MYC-2267 Target:  5'-ATTATAGGTACTATAAACCCTAATTTT-3'  (SEQ ID NO: 784)

5'-ACUAUAAACCCUAAUUUUUUUAtt-3'     (SEQ ID NO: 131)
                  3'-CAUGAUAUUUGGGAUUAAAAAAAAUAA-5'  (SEQ ID NO: 458)
MYC-2274 Target:  5'-GTACTATAAACCCTAATTTTTTTATT-3'   (SEQ ID NO: 785)

5'-CCCUAAUUUUUUUAUUUAAGUAca-3'     (SEQ ID NO: 132)
                  3'-UUGGGAUUAAAAAAAUAAAUUCAUGU-5'   (SEQ ID NO: 459)
MYC-2282 Target:  5'-AACCCTAATTTTTTTATTTAAGTACA-3'   (SEQ ID NO: 786)

5'-AUUUUUUUAUUUAAGUACAUUUtg-3'     (SEQ ID NO: 133)
                  3'-AUUAAAAAAAUAAAUUCAUGUAAAAC-5'   (SEQ ID NO: 460)
MYC-2287 Target:  5'-TAATTTTTTTATTTAAGTACATTTTG-3'   (SEQ ID NO: 787)

5'-UAUUUAAGUACAUUUUGCUUUUUaa-3'    (SEQ ID NO: 134)
                  3'-AAAUAAAUUCAUGUAAAACGAAAAAUU-5'  (SEQ ID NO: 461)
MYC-2295 Target:  5'-TTTATTTAAGTACATTTTGCTTTTTAA-3'  (SEQ ID NO: 788)

5'-AAGUACAUUUUGCUUUUUAAAGUtg-3'    (SEQ ID NO: 135)
                  3'-AAUUCAUGUAAAACGAAAAAUUUCAC-5'   (SEQ ID NO: 462)
MYC-2300 Target:  5'-TTAAGTACATTTTGCTTTTTAAAGTTG-3'  (SEQ ID NO: 789)

5'-AUUUUGCUUUUUAAAGUUGAUUUtt-3'    (SEQ ID NO: 136)
                  3'-UGUAAAACGAAAAAUUUCAACUAAAAA-5'  (SEQ ID NO: 463)
MYC-2306 Target:  5'-ACATTTGCTTTTTAAAGTTGATTTTT-3'   (SEQ ID NO: 790)

5'-CUUUUUAAAGUUGAUUUUUUCUat-3'     (SEQ ID NO: 137)
                  3'-ACGAAAAAUUUCAACUAAAAAAGAUA-5'   (SEQ ID NO: 464)
MYC-2312 Target:  5'-TGCTTTTTAAAGTTGATTTTTTCTAT-3'   (SEQ ID NO: 791)

5'-UAUUGUUUUUAGAAAAAAUAAAAta-3'    (SEQ ID NO: 138)
                  3'-AGAUAACAAAAAUCUUUUUUAUUUUAU-5'  (SEQ ID NO: 465)
MYC-2334 Target:  5'-TCTATTGTTTTTAGAAAAAATAAAATA-3'  (SEQ ID NO: 792)

5'-UUUUUAGAAAAAUAAAAUAACUgg-3'     (SEQ ID NO: 139)
                  3'-ACAAAAAUCUUUUUUAUUUUAUUGACC-5'  (SEQ ID NO: 466)
MYC-2339 Target:  5'-TGTTTTTAGAAAAATAAAATAACTGG-3'   (SEQ ID NO: 793)

5'-AAAAAUAAAAUAACUGGCAAAUAta-3'    (SEQ ID NO: 140)
                  3'-CUUUUUUAUUUUAUUGACCGUUUAUAU-5'  (SEQ ID NO: 467)
MYC-2347 Target:  5'-GAAAAATAAATAACTGGCAAATATA-3'    (SEQ ID NO: 794)

5'-AAUAACUGGCAAAUAUAUCAUUGag-3'    (SEQ ID NO: 141)
                  3'-UUUUAUUGACCGUUUAUAUAGUAACUC-5'  (SEQ ID NO: 468)
MYC-2355 Target:  5'-AAAATAACTGGCAAATATATCATTGAG-3'  (SEQ ID NO: 795)

5'-CAAAUAUAUCAUUGAGCCAAAUCtt-3'    (SEQ ID NO: 142)
                  3'-CCGUUUAUAUAGUAACUCGGUUUAGAA-5'  (SEQ ID NO: 469)
MYC-2364 Target:  5'-GGCAAATATATCATTGAGCCAAATCTT-3'  (SEQ ID NO: 796)
```

TABLE 2-continued

Selected Human Anti-MYC DsiRNA Agents (Asymmetrics)

```
                   5'-AUCAUUGAGCCAAAUCUUAAAAAaa-3'    (SEQ ID NO: 143)

3'-UAUAGUAACUCGGUUUAGAAUUUUUUU-5'  (SEQ ID NO: 470)

MYC-2371 Target:   5'-ATATCATTGAGCCAAATCTTAAAAAAA-3'  (SEQ ID NO: 797)

5'-GAGCCAAAUCUUAAAAAAAAAAAaa-3'    (SEQ ID NO: 144)

3'-AACUCGGUUUAGAAUUUUUUUUUUUUU-5'  (SEQ ID NO: 471)

MYC-2377 Target:   5'-TTGAGCCAAATCTTAAAAAAAAAAAAA-3'  (SEQ ID NO: 798)

5'-ACUCGCUGUAGUAAUUCCAGCGAga-3'    (SEQ ID NO: 145)

3'-AUUGAGCGACAUCAUUAAGGUCGCUCU-5'  (SEQ ID NO: 472)

MYC-188 Target:    5'-TAACTCGCTGTAGTAATTCCAGCGAGA-3'  (SEQ ID NO: 799)

5'-CUCGCUGUAGUAAUUCCAGCGAGag-3'    (SEQ ID NO: 146)

3'-UUGAGCGACAUCAUUAAGGUCGCUCUC-5'  (SEQ ID NO: 473)

MYC-189 Target:    5'-AACTCGCTGTAGTAATTCCAGCGAGAG-3'  (SEQ ID NO: 800)

5'-UCGCUGUAGUAAUUCCAGCGAGAgg-3'    (SEQ ID NO: 147)

3'-UGAGCGACAUCAUUAAGGUCGCUCUCC-5'  (SEQ ID NO: 474)

MYC-190 Target:    5'-ACTCGCTGTAGTAATTCCAGCGAGAGG-3'  (SEQ ID NO: 801)

5'-CGCUGUAGUAAUUCCAGCGAGAGgc-3'    (SEQ ID NO: 148)

3'-GAGCGACAUCAUUAAGGUCGCUCUCCG-5'  (SEQ ID NO: 475)

MYC-191 Target:    5'-CTCGCTGTAGTAATTCCAGCGAGAGGC-3'  (SEQ ID NO: 802)

5'-GCUGUAGUAAUUCCAGCGAGAGGca-3'    (SEQ ID NO: 149)

3'-AGCGACAUCAUUAAGGUCGCUCUCCGU-5'  (SEQ ID NO: 476)

MYC-192 Target:    5'-TCGCTGTAGTAATTCCAGCGAGAGGCA-3'  (SEQ ID NO: 803)

5'-CUGUAGUAAUUCCAGCGAGAGGCag-3'    (SEQ ID NO: 150)

3'-GCGACAUCAUUAAGGUCGCUCUCCGUC-5'  (SEQ ID NO: 477)

MYC-193 Target:    5'-CGCTGTAGTAATTCCAGCGAGAGGCAG-3'  (SEQ ID NO: 804)

5'-UGUAGUAAUUCCAGCGAGAGGCAga-3'    (SEQ ID NO: 151)

3'-CGACAUCAUUAAGGUCGCUCUCCGUCU-5'  (SEQ ID NO: 478)

MYC-194 Target:    5'-GCTGTAGTAATTCCAGCGAGAGGCAGA-3'  (SEQ ID NO: 805)

5'-GUAGUAAUUCCAGCGAGAGGCAGag-3'    (SEQ ID NO: 152)

3'-GACAUCAUUAAGGUCGCUCUCCGUCUC-5'  (SEQ ID NO: 479)

MYC-195 Target:    5'-CTGTAGTAATTCCAGCGAGAGGCAGAG-3'  (SEQ ID NO: 806)

5'-CUUCACCAACAGGAACUAUGACCtc-3'    (SEQ ID NO: 153)

3'-UCGAAGUGGUUGUCCUUGAUACUGGAG-5'  (SEQ ID NO: 480)

MYC-612 Target:    5'-AGCTTCACCAACAGGAACTATGACCTC-3'  (SEQ ID NO: 807)

5'-UUCACCAACAGGAACUAUGACCUcg-3'    (SEQ ID NO: 154)

3'-CGAAGUGGUUGUCCUUGAUACUGGAGC-5'  (SEQ ID NO: 481)

MYC-613 Target:    5'-GCTTCACCAACAGGAACTATGACCTCG-3'  (SEQ ID NO: 808)

5'-UCACCAACAGGAACUAUGACCUCga-3'    (SEQ ID NO: 155)

3'-GAAGUGGUUGUCCUUGAUACUGGAGCU-5'  (SEQ ID NO: 482)

MYC-614 Target:    5'-CTTCACCAACAGGAACTATGACCTCGA-3'  (SEQ ID NO: 809)
```

TABLE 2-continued

Selected Human Anti-MYC DsiRNA Agents (Asymmetrics)

```
                    5'-CACCAACAGGAACUAUGACCUCGac-3'    (SEQ ID NO: 156)
                    3'-AAGUGGUUGUCCUUGAUACUGGAGCUG-5'  (SEQ ID NO: 483)
MYC-615 Target:     5'-TTCACCAACAGGAACTATGACCTCGAC-3'  (SEQ ID NO: 810)
                    5'-ACCAACAGGAACUAUGACCUCGAct-3'    (SEQ ID NO: 157)
                    3'-AGUGGUUGUCCUUGAUACUGGAGCUGA-5'  (SEQ ID NO: 484)
MYC-616 Target:     5'-TCACCAACAGGAACTATGACCTCGACT-3'  (SEQ ID NO: 811)
                    5'-CCAACAGGAACUAUGACCUCGACTa-3'    (SEQ ID NO: 158)
                    3'-GUGGUUGUCCUUGAUACUGGAGCUGAU-5'  (SEQ ID NO: 485)
MYC-617 Target:     5'-CACCAACAGGAACTATGACCTCGACTA-3'  (SEQ ID NO: 812)
                    5'-CAACAGGAACUAUGACCUCGACUac-3'    (SEQ ID NO: 159)
                    3'-UGGUUGUCCUUGAUACUGGAGCUGAUG-5'  (SEQ ID NO: 486)
MYC-618 Target:     5'-ACCAACAGGAACTATGACCTCGACTAC-3'  (SEQ ID NO: 813)
                    5'-AACAGGAACUAUGACCUCGACUAcg-3'    (SEQ ID NO: 160)
                    3'-GGUUGUCCUUGAUACUGGAGCUGAUGC-5'  (SEQ ID NO: 487)
MYC-619 Target:     5'-CCAACAGGAACTATGACCTCGACTACG-3'  (SEQ ID NO: 814)
                    5'-ACAGGAACUAUGACCUCGACUACga-3'    (SEQ ID NO: 161)
                    3'-GUUGUCCUUGAUACUGGAGCUGAUGCU-5'  (SEQ ID NO: 488)
MYC-620 Target:     5'-CAACAGGAACTATGACCTCGACTACGA-3'  (SEQ ID NO: 815)
                    5'-CAGGAACUAUGACCUCGACUACGac-3'    (SEQ ID NO: 162)
                    3'-UUGUCCUUGAUACUGGAGCUGAUGCUG-5'  (SEQ ID NO: 489)
MYC-621 Target:     5'-AACAGGAACTATGACCTCGACTACGAC-3'  (SEQ ID NO: 816)
                    5'-AGGAACUAUGACCUCGACUACGACt-3'    (SEQ ID NO: 163)
                    3'-UGUCCUUGAUACUGGAGCUGAUGCUGA-5'  (SEQ ID NO: 490)
MYC-622 Target:     5'-ACAGGAACTATGACCTCGACTACGACT-3'  (SEQ ID NO: 817)
                    5'-GGAACUAUGACCUCGACUACGACtc-3'    (SEQ ID NO: 164)
                    3'-GUCCUUGAUACUGGAGCUGAUGCUGAG-5'  (SEQ ID NO: 491)
MYC-623 Target:     5'-CAGGAACTATGACCTCGACTACGACTC-3'  (SEQ ID NO: 818)
                    5'-GAACUAUGACCUCGACUACGACUcg-3'    (SEQ ID NO: 165)
                    3'-UCCUUGAUACUGGAGCUGAUGCUGAGC-5'  (SEQ ID NO: 492)
MYC-624 Target:     5'-AGGAACTATGACCTCGACTACGACTCG-3'  (SEQ ID NO: 819)
                    5'-AACUAUGACCUCGACUACGACUCgg-3'    (SEQ ID NO: 166)
                    3'-CCUUGAUACUGGAGCUGAUGCUGAGCC-5'  (SEQ ID NO: 493)
MYC-625 Target:     5'-GGAACTATGACCTCGACTACGACTCGG-3'  (SEQ ID NO: 820)
                    5'-ACUAUGACCUCGACUACGACUCGgt-3'    (SEQ ID NO: 167)
                    3'-CUUGAUACUGGAGCUGAUGCUGAGCCA-5'  (SEQ ID NO: 494)
MYC-626 Target:     5'-GAACTATGACCTCGACTACGACTCGGT-3'  (SEQ ID NO: 821)
                    5'-CUAUGACCUCGACUACGACUCGGtg-3'    (SEQ ID NO: 168)
                    3'-UUGAUACUGGAGCUGAUGCUGAGCCAC-5'  (SEQ ID NO: 495)
MYC-627 Target:     5'-AACTATGACCTCGACTACGACTCGGTG-3'  (SEQ ID NO: 822)
```

TABLE 2-continued

Selected Human Anti-MYC DsiRNA Agents (Asymmetrics)

|  |  |  |
|---|---|---|
|  | 5'-UAUGACCUCGACUACGACUCGGUgc-3' | (SEQ ID NO: 169) |
|  | 3'-<u>UGA</u>UACUGGAGCUGAUGCUGAGCCA<u>CG</u>-5' | (SEQ ID NO: 496) |
| MYC-628 Target: | 5'-ACTATGACCTCGACTACGACTCGGTGC-3' | (SEQ ID NO: 823) |
|  | 5'-AUGACCUCGACUACGACUCGGUGca-3' | (SEQ ID NO: 170) |
|  | 3'-<u>GAU</u>ACUGGAGCUGAUGCUGAGCCAC<u>GU</u>-5' | (SEQ ID NO: 497) |
| MYC-629 Target: | 5'-CTATGACCTCGACTACGACTCGGTGCA-3' | (SEQ ID NO: 824) |
|  | 5'-GAGGAUAUCUGGAAGAAAUUCGAgc-3' | (SEQ ID NO: 171) |
|  | 3'-<u>CGC</u>UCCUAUAGACCUUCUUUAAGCU<u>CG</u>-5' | (SEQ ID NO: 498) |
| MYC-733 Target: | 5'-GCGAGGATATCTGGAAGAAATTCGAGC-3' | (SEQ ID NO: 825) |
|  | 5'-AGGAUAUCUGGAAGAAAUUCGAGct-3' | (SEQ ID NO: 172) |
|  | 3'-<u>GCU</u>CCUAUAGACCUUCUUUAAGCUC<u>GA</u>-5' | (SEQ ID NO: 499) |
| MYC-734 Target: | 5'-CGAGGATATCTGGAAGAAATTCGAGCT-3' | (SEQ ID NO: 826) |
|  | 5'-GGAUAUCUGGAAGAAAUUCGAGCtg-3' | (SEQ ID NO: 173) |
|  | 3'-<u>CUC</u>CUAUAGACCUUCUUUAAGCUCG<u>AC</u>-5' | (SEQ ID NO: 500) |
| MYC-735 Target: | 5'-GAGGATATCTGGAAGAAATTCGAGCTG-3' | (SEQ ID NO: 827) |
|  | 5'-GAUAUCUGGAAGAAAUUCGAGCUgc-3' | (SEQ ID NO: 174) |
|  | 3'-<u>UCC</u>UAUAGACCUUCUUUAAGCUCGA<u>CG</u>-5' | (SEQ ID NO: 501) |
| MYC-736 Target: | 5'-AGGATATCTGGAAGAAATTCGAGCTGC-3' | (SEQ ID NO: 828) |
|  | 5'-AUAUCUGGAAGAAAUUCGAGCUGct-3' | (SEQ ID NO: 175) |
|  | 3'-<u>CCU</u>AUAGACCUUCUUUAAGCUCGAC<u>GA</u>-5' | (SEQ ID NO: 502) |
| MYC-737 Target: | 5'-GGATATCTGGAAGAAATTCGAGCTGCT-3' | (SEQ ID NO: 829) |
|  | 5'-UAUCUGGAAGAAAUUCGAGCUGCtg-3' | (SEQ ID NO: 176) |
|  | 3'-<u>CUA</u>UAGACCUUCUUUAAGCUCGACG<u>AC</u>-5' | (SEQ ID NO: 503) |
| MYC-738 Target: | 5'-GATATCTGGAAGAAATTCGAGCTGCTG-3' | (SEQ ID NO: 830) |
|  | 5'-AUCUGGAAGAAAUUCGAGCUGCUgc-3' | (SEQ ID NO: 177) |
|  | 3'-<u>UAU</u>AGACCUUCUUUAAGCUCGACGA<u>CG</u>-5' | (SEQ ID NO: 504) |
| MYC-739 Target: | 5'-ATATCTGGAAGAAATTCGAGCTGCTGC-3' | (SEQ ID NO: 831) |
|  | 5'-UCUGGAAGAAAUUCGAGCUGCUGcc-3' | (SEQ ID NO: 178) |
|  | 3'-<u>AUA</u>GACCUUCUUUAAGCUCGACGAC<u>GG</u>-5' | (SEQ ID NO: 505) |
| MYC-740 Target: | 5'-TATCTGGAAGAAATTCGAGCTGCTGCC-3' | (SEQ ID NO: 832) |
|  | 5'-CUGGAAGAAAUUCGAGCUGCUGCcc-3' | (SEQ ID NO: 179) |
|  | 3'-<u>UAG</u>ACCUUCUUUAAGCUCGACGACG<u>GG</u>-5' | (SEQ ID NO: 506) |
| MYC-741 Target: | 5'-ATCTGGAAGAAATTCGAGCTGCTGCCC-3' | (SEQ ID NO: 833) |
|  | 5'-UGGAAGAAAUUCGAGCUGCUGCCca-3' | (SEQ ID NO: 180) |
|  | 3'-<u>AGA</u>CCUUCUUUAAGCUCGACGACGG<u>GU</u>-5' | (SEQ ID NO: 507) |
| MYC-742 Target: | 5'-TCTGGAAGAAATTCGAGCTGCTGCCCA-3' | (SEQ ID NO: 834) |
|  | 5'-GGAAGAAAUUCGAGCUGCUGCCCac-3' | (SEQ ID NO: 181) |
|  | 3'-<u>GAC</u>CUUCUUUAAGCUCGACGACGGG<u>UG</u>-5' | (SEQ ID NO: 508) |
| MYC-743 Target: | 5'-CTGGAAGAAATTCGAGCTGCTGCCCAC-3' | (SEQ ID NO: 835) |

TABLE 2-continued

Selected Human Anti-MYC DsiRNA Agents (Asymmetrics)

```
              5'-AGCCGCCGCUCCGGGCUCUGCUCgc-3'   (SEQ ID NO: 182)
              3'-GAUCGGCGGCGAGGCCCGAGACGAGCG-5' (SEQ ID NO: 509)
MYC-784 Target: 5'-CTAGCCGCCGCTCCGGGCTCTGCTCGC-3' (SEQ ID NO: 836)

5'-GCCGCCGCUCCGGGCUCUGCUCGcc-3'   (SEQ ID NO: 183)
              3'-AUCGGCGGCGAGGCCCGAGACGAGCGG-5' (SEQ ID NO: 510)
MYC-785 Target: 5'-TAGCCGCCGCTCCGGGCTCTGCTCGCC-3' (SEQ ID NO: 837)

5'-CCGCCGCUCCGGGCUCUGCUCGCcc-3'   (SEQ ID NO: 184)
              3'-UCGGCGGCGAGGCCCGAGACGAGCGGG-5' (SEQ ID NO: 511)
MYC-786 Target: 5'-AGCCGCCGCTCCGGGCTCTGCTCGCCC-3' (SEQ ID NO: 838)

5'-CGCCGCUCCGGGCUCUGCUCGCCct-3'   (SEQ ID NO: 185)
              3'-CGGCGGCGAGGCCCGAGACGAGCGGGA-5' (SEQ ID NO: 512)
MYC-787 Target: 5'-GCCGCCGCTCCGGGCTCTGCTCGCCCT-3' (SEQ ID NO: 839)

5'-GCCGCUCCGGGCUCUGCUCGCCCtc-3'   (SEQ ID NO: 186)
              3'-GGCGGCGAGGCCCGAGACGAGCGGGAG-5' (SEQ ID NO: 513)
MYC-788 Target: 5'-CCGCCGCTCCGGGCTCTGCTCGCCCTC-3' (SEQ ID NO: 840)

5'-GGAGGAGACAUGGUGAACCAGAGtt-3'   (SEQ ID NO: 187)
              3'-ACCCUCCUCUGUACCACUUGGUCUCAA-5' (SEQ ID NO: 514)
MYC-913 Target: 5'-TGGGAGGAGACATGGTGAACCAGAGTT-3' (SEQ ID NO: 841)

5'-GAGGAGACAUGGUGAACCAGAGUtt-3'   (SEQ ID NO: 188)
              3'-CCCUCCUCUGUACCACUUGGUCUCAAA-5' (SEQ ID NO: 515)
MYC-914 Target: 5'-GGGAGGAGACATGGTGAACCAGAGTTT-3' (SEQ ID NO: 842)

5'-AGGAGACAUGGUGAACCAGAGUUtc-3'   (SEQ ID NO: 189)
              3'-CCUCCUCUGUACCACUUGGUCUCAAAG-5' (SEQ ID NO: 516)
MYC-915 Target: 5'-GGAGGAGACATGGTGAACCAGAGTTTC-3' (SEQ ID NO: 843)

5'-GGAGACAUGGUGAACCAGAGUUUca-3'   (SEQ ID NO: 190)
              3'-CUCCUCUGUACCACUUGGUCUCAAAGU-5' (SEQ ID NO: 517)
MYC-916 Target: 5'-GAGGAGACATGGTGAACCAGAGTTTCA-3' (SEQ ID NO: 844)

5'-GAGACAUGGUGAACCAGAGUUUCat-3'   (SEQ ID NO: 191)
              3'-UCCUCUGUACCACUUGGUCUCAAAGUA-5' (SEQ ID NO: 518)
MYC-917 Target: 5'-AGGAGACATGGTGAACCAGAGTTTCAT-3' (SEQ ID NO: 845)

5'-GACGACGAGACCUUCAUCAAAAAca-3'   (SEQ ID NO: 192)
              3'-GCCUGCUGCUCUGGAAGUAGUUUUUGU-5' (SEQ ID NO: 519)
MYC-952 Target: 5'-CGGACGACGAGACCTTCATCAAAAACA-3' (SEQ ID NO: 846)

5'-ACGACGAGACCUUCAUCAAAAACat-3'   (SEQ ID NO: 193)
              3'-CCUGCUGCUCUGGAAGUAGUUUUUGUA-5' (SEQ ID NO: 520)
MYC-953 Target: 5'-GGACGACGAGACCTTCATCAAAAACAT-3' (SEQ ID NO: 847)

5'-AACAUCAUCAUCCAGGACUGUAUgt-3'   (SEQ ID NO: 194)
              3'-UUUUGUAGUAGUAGGUCCUGACAUACA-5' (SEQ ID NO: 521)
MYC-973 Target: 5'-AAAACATCATCATCCAGGACTGTATGT-3' (SEQ ID NO: 848)
```

TABLE 2-continued

Selected Human Anti-MYC DsiRNA Agents (Asymmetrics)

```
                5'-ACAUCAUCAUCCAGGACUGUAUGtg-3'   (SEQ ID NO: 195)
                3'-UUUGUAGUAGUAGGUCCUGACAUACAC-5' (SEQ ID NO: 522)
MYC-974 Target: 5'-AAACATCATCATCCAGGACTGTATGTG-3' (SEQ ID NO: 849)
                5'-CAUCAUCAUCCAGGACUGUAUGUgg-3'   (SEQ ID NO: 196)
                3'-UUGUAGUAGUAGGUCCUGACAUACACC-5' (SEQ ID NO: 523)
MYC-975 Target: 5'-AACATCATCATCCAGGACTGTATGTGG-3' (SEQ ID NO: 850)
                5'-AUCAUCAUCCAGGACUGUAUGUGga-3'   (SEQ ID NO: 197)
                3'-UGUAGUAGUAGGUCCUGACAUACACCU-5' (SEQ ID NO: 524)
MYC-976 Target: 5'-ACATCATCATCCAGGACTGTATGTGGA-3' (SEQ ID NO: 851)
                5'-UCAUCAUCCAGGACUGUAUGUGGag-3'   (SEQ ID NO: 198)
                3'-GUAGUAGUAGGUCCUGACAUACACCUC-5' (SEQ ID NO: 525)
MYC-977 Target: 5'-CATCATCATCCAGGACTGTATGTGGAG-3' (SEQ ID NO: 852)
                5'-CAUCAUCCAGGACUGUAUGUGGAgc-3'   (SEQ ID NO: 199)
                3'-UAGUAGUAGGUCCUGACAUACACCUCG-5' (SEQ ID NO: 526)
MYC-978 Target: 5'-ATCATCATCCAGGACTGTATGTGGAGC-3' (SEQ ID NO: 853)
                5'-AUCAUCCAGGACUGUAUGUGGAGcg-3'   (SEQ ID NO: 200)
                3'-AGUAGUAGGUCCUGACAUACACCUCGC-5' (SEQ ID NO: 527)
MYC-979 Target: 5'-TCATCATCCAGGACTGTATGTGGAGCG-3' (SEQ ID NO: 854)
                5'-UCAUCCAGGACUGUAUGUGGAGCgg-3'   (SEQ ID NO: 201)
                3'-GUAGUAGGUCCUGACAUACACCUCGCC-5' (SEQ ID NO: 528)
MYC-980 Target: 5'-CATCATCCAGGACTGTATGTGGAGCGG-3' (SEQ ID NO: 855)
                5'-CAUCCAGGACUGUAUGUGGAGCGgc-3'   (SEQ ID NO: 202)
                3'-UAGUAGGUCCUGACAUACACCUCGCCG-5' (SEQ ID NO: 529)
MYC-981 Target: 5'-ATCATCCAGGACTGTATGTGGAGCGGC-3' (SEQ ID NO: 856)
                5'-AUCCAGGACUGUAUGUGGAGCGGct-3'   (SEQ ID NO: 203)
                3'-AGUAGGUCCUGACAUACACCUCGCCGA-5' (SEQ ID NO: 530)
MYC-982 Target: 5'-TCATCCAGGACTGTATGTGGAGCGGCT-3' (SEQ ID NO: 857)
                5'-UCCAGGACUGUAUGUGGAGCGGCtt-3'   (SEQ ID NO: 204)
                3'-GUAGGUCCUGACAUACACCUCGCCGAA-5' (SEQ ID NO: 531)
MYC-983 Target: 5'-CATCCAGGACTGTATGTGGAGCGGCTT-3' (SEQ ID NO: 858)
                5'-CCAGGACUGUAUGUGGAGCGGCUtc-3'   (SEQ ID NO: 205)
                3'-UAGGUCCUGACAUACACCUCGCCGAAG-5' (SEQ ID NO: 532)
MYC-984 Target: 5'-ATCCAGGACTGTATGTGGAGCGGCTTC-3' (SEQ ID NO: 859)
                5'-CAGGACUGUAUGUGGAGCGGCUUct-3'   (SEQ ID NO: 206)
                3'-AGGUCCUGACAUACACCUCGCCGAAGA-5' (SEQ ID NO: 533)
MYC-985 Target: 5'-TCCAGGACTGTATGTGGAGCGGCTTCT-3' (SEQ ID NO: 860)
                5'-AGGACUGUAUGUGGAGCGGCUUCtc-3'   (SEQ ID NO: 207)
                3'-GGUCCUGACAUACACCUCGCCGAAGAG-5' (SEQ ID NO: 534)
MYC-986 Target: 5'-CCAGGACTGTATGTGGAGCGGCTTCTC-3' (SEQ ID NO: 861)
```

TABLE 2-continued

Selected Human Anti-MYC DsiRNA Agents (Asymmetrics)

```
              5'-GAGAAGCUGGCCUCCUACCAGGCtg-3'     (SEQ ID NO: 208)
              3'-GUCUCUUCGACCGGAGGAUGGUCCGAC-5'  (SEQ ID NO: 535)

MYC-1033 Target: 5'-CAGAGAAGCTGGCCTCCTACCAGGCTG-3' (SEQ ID NO: 862)
              5'-AGAAGCUGGCCUCCUACCAGGCUgc-3'    (SEQ ID NO: 209)
              3'-UCUCUUCGACCGGAGGAUGGUCCGACG-5'  (SEQ ID NO: 536)

MYC-1034 Target: 5'-AGAGAAGCTGGCCTCCTACCAGGCTGC-3' (SEQ ID NO: 863)
              5'-GAAGCUGGCCUCCUACCAGGCUGcg-3'    (SEQ ID NO: 210)
              3'-CUCUUCGACCGGAGGAUGGUCCGACGC-5'  (SEQ ID NO: 537)

MYC-1035 Target: 5'-GAGAAGCTGGCCTCCTACCAGGCTGCG-3' (SEQ ID NO: 864)
              5'-AAGCUGGCCUCCUACCAGGCUGCgc-3'    (SEQ ID NO: 211)
              3'-UCUUCGACCGGAGGAUGGUCCGACGCG-5'  (SEQ ID NO: 538)

MYC-1036 Target: 5'-AGAAGCTGGCCTCCTACCAGGCTGCGC-3' (SEQ ID NO: 865)
              5'-AGCUGGCCUCCUACCAGGCUGCGcg-3'    (SEQ ID NO: 212)
              3'-CUUCGACCGGAGGAUGGUCCGACGCGC-5'  (SEQ ID NO: 539)

MYC-1037 Target: 5'-GAAGCTGGCCTCCTACCAGGCTGCGCG-3' (SEQ ID NO: 866)
              5'-GCUGGCCUCCUACCAGGCUGCGCgc-3'    (SEQ ID NO: 213)
              3'-UUCGACCGGAGGAUGGUCCGACGCGCG-5'  (SEQ ID NO: 540)

MYC-1038 Target: 5'-AAGCTGGCCTCCTACCAGGCTGCGCGC-3' (SEQ ID NO: 867)
              5'-CUGGCCUCCUACCAGGCUGCGCGca-3'    (SEQ ID NO: 214)
              3'-UCGACCGGAGGAUGGUCCGACGCGCGU-5'  (SEQ ID NO: 541)

MYC-1039 Target: 5'-AGCTGGCCTCCTACCAGGCTGCGCGCA-3' (SEQ ID NO: 868)
              5'-UGGCCUCCUACCAGGCUGCGCGCaa-3'    (SEQ ID NO: 215)
              3'-CGACCGGAGGAUGGUCCGACGCGCGUU-5'  (SEQ ID NO: 542)

MYC-1040 Target: 5'-GCTGGCCTCCTACCAGGCTGCGCGCAA-3' (SEQ ID NO: 869)
              5'-GGCCUCCUACCAGGCUGCGCGCAaa-3'    (SEQ ID NO: 216)
              3'-GACCGGAGGAUGGUCCGACGCGCGUUU-5'  (SEQ ID NO: 543)

MYC-1041 Target: 5'-CTGGCCTCCTACCAGGCTGCGCGCAAA-3' (SEQ ID NO: 870)
              5'-GCCUCCUACCAGGCUGCGCGCAAag-3'    (SEQ ID NO: 217)
              3'-ACCGGAGGAUGGUCCGACGCGCGUUUC-5'  (SEQ ID NO: 544)

MYC-1042 Target: 5'-TGGCCTCCTACCAGGCTGCGCGCAAAG-3' (SEQ ID NO: 871)
              5'-CCUCCUACCAGGCUGCGCGCAAAga-3'    (SEQ ID NO: 218)
              3'-CCGGAGGAUGGUCCGACGCGCGUUUCU-5'  (SEQ ID NO: 545)

MYC-1043 Target: 5'-GGCCTCCTACCAGGCTGCGCGCAAAGA-3' (SEQ ID NO: 872)
              5'-CUCCUACCAGGCUGCGCGCAAAGac-3'    (SEQ ID NO: 219)
              3'-CGGAGGAUGGUCCGACGCGCGUUUCUG-5'  (SEQ ID NO: 546)

MYC-1044 Target: 5'-GCCTCCTACCAGGCTGCGCGCAAAGAC-3' (SEQ ID NO: 873)
              5'-UCCUACCAGGCUGCGCGCAAAGAca-3'    (SEQ ID NO: 220)
              3'-GGAGGAUGGUCCGACGCGCGUUUCUGU-5'  (SEQ ID NO: 547)

MYC-1045 Target: 5'-CCTCCTACCAGGCTGCGCGCAAAGACA-3' (SEQ ID NO: 874)
```

TABLE 2-continued

Selected Human Anti-MYC DsiRNA Agents (Asymmetrics)

```
                5'-CCUACCAGGCUGCGCGCAAAGACag-3'      (SEQ ID NO: 221)

3'-GAGGAUGGUCCGACGCGCGUUUCUGUC-5'    (SEQ ID NO: 548)

MYC-1046 Target: 5'-CTCCTACCAGGCTGCGCGCAAAGACAG-3'   (SEQ ID NO: 875)

5'-CUACCAGGCUGCGCGCAAAGACAgc-3'     (SEQ ID NO: 222)

3'-AGGAUGGUCCGACGCGCGUUUCUGUCG-5'   (SEQ ID NO: 549)

MYC-1047 Target: 5'-TCCTACCAGGCTGCGCGCAAAGACAGC-3'   (SEQ ID NO: 876)

5'-UACCAGGCUGCGCGCAAAGACAGcg-3'     (SEQ ID NO: 223)

3'-GGAUGGUCCGACGCGCGUUUCUGUCGC-5'   (SEQ ID NO: 550)

MYC-1048 Target: 5'-CCTACCAGGCTGCGCGCAAAGACAGCG-3'   (SEQ ID NO: 877)

5'-ACCAGGCUGCGCGCAAAGACAGCgg-3'     (SEQ ID NO: 224)

3'-GAUGGUCCGACGCGCGUUUCUGUCGCC-5'   (SEQ ID NO: 551)

MYC-1049 Tar-   5'-CTACCAGGCTGCGCGCAAAGACAGCGG-3'   (SEQ ID NO: 878)
get:

5'-CCAGGCUGCGCGCAAAGACAGCGgc-3'     (SEQ ID NO: 225)

3'-AUGGUCCGACGCGCGUUUCUGUCGCCG-5'   (SEQ ID NO: 552)

MYC-1050 Tar-   5'-TACCAGGCTGCGCGCAAAGACAGCGGC-3'   (SEQ ID NO: 879)
get:

5'-CAGGCUGCGCGCAAAGACAGCGGca-3'     (SEQ ID NO: 226)

3'-UGGUCCGACGCGCGUUUCUGUCGCCGU-5'   (SEQ ID NO: 553)

MYC-1051 Tar-   5'-ACCAGGCTGCGCGCAAAGACAGCGGCA-3'   (SEQ ID NO: 880)
get:

5'-AGGCUGCGCGCAAAGACAGCGGCag-3'     (SEQ ID NO: 227)

3'-GGUCCGACGCGCGUUUCUGUCGCCGUC-5'   (SEQ ID NO: 554)

MYC-1052 Tar-   5'-CCAGGCTGCGCGCAAAGACAGCGGCAG-3'   (SEQ ID NO: 881)
get:

5'-GGCUGCGCGCAAAGACAGCGGCAgc-3'     (SEQ ID NO: 228)

3'-GUCCGACGCGCGUUUCUGUCGCCGUCG-5'   (SEQ ID NO: 555)

MYC-1053 Tar-   5'-CAGGCTGCGCGCAAAGACAGCGGCAGC-3'   (SEQ ID NO: 882)
get:

5'-CACAGCGUCUGCUCCACCUCCAGct-3'     (SEQ ID NO: 229)

3'-CGGUGUCGCAGACGAGGUGGAGGUCGA-5'   (SEQ ID NO: 556)

MYC-1096 Tar-   5'-GCCACAGCGTCTGCTCCACCTCCAGCT-3'   (SEQ ID NO: 883)
get:

5'-ACAGCGUCUGCUCCACCUCCAGCtt-3'     (SEQ ID NO: 230)

3'-GGUGUCGCAGACGAGGUGGAGGUCGAA-5'   (SEQ ID NO: 557)

MYC-1097 Tar-   5'-CCACAGCGTCTGCTCCACCTCCAGCTT-3'   (SEQ ID NO: 884)
get:

5'-CAGCGUCUGCUCCACCUCCAGCUtg-3'     (SEQ ID NO: 231)

3'-GUGUCGCAGACGAGGUGGAGGUCGAAC-5'   (SEQ ID NO: 558)

MYC-1098 Tar-   5'-CACAGCGTCTGCTCCACCTCCAGCTTG-3'   (SEQ ID NO: 885)
get:
```

TABLE 2-continued

Selected Human Anti-MYC DsiRNA Agents (Asymmetrics)

|  |  |  |
|---|---|---|
|  | 5'-AGCGUCUGCUCCACCUCCAGCUUgt-3' | (SEQ ID NO: 232) |
|  | 3'-UGUCGCAGACGAGGUGGAGGUCGAACA-5' | (SEQ ID NO: 559) |
| MYC-1099 Target: | 5'-ACAGCGTCTGCTCCACCTCCAGCTTGT-3' | (SEQ ID NO: 886) |
|  | 5'-GCGUCUGCUCCACCUCCAGCUUGta-3' | (SEQ ID NO: 233) |
|  | 3'-GUCGCAGACGAGGUGGAGGUCGAACAU-5' | (SEQ ID NO: 560) |
| MYC-1100 Target: | 5'-CAGCGTCTGCTCCACCTCCAGCTTGTA-3' | (SEQ ID NO: 887) |
|  | 5'-CGUCUGCUCCACCUCCAGCUUGUac-3' | (SEQ ID NO: 234) |
|  | 3'-UCGCAGACGAGGUGGAGGUCGAACAUG-5' | (SEQ ID NO: 561) |
| MYC-1101 Target: | 5'-AGCGTCTGCTCCACCTCCAGCTTGTAC-3' | (SEQ ID NO: 888) |
|  | 5'-CUCAACGACAGCAGCUCGCCCAAgt-3' | (SEQ ID NO: 235) |
|  | 3'-GAGAGUUGCUGUCGUCGAGCGGGUUCA-5' | (SEQ ID NO: 562) |
| MYC-1189 Target: | 5'-CTCTCAACGACAGCAGCTCGCCCAAGT-3' | (SEQ ID NO: 889) |
|  | 5'-UCAACGACAGCAGCUCGCCCAAGtc-3' | (SEQ ID NO: 236) |
|  | 3'-AGAGUUGCUGUCGUCGAGCGGGUUCAG-5' | (SEQ ID NO: 563) |
| MYC-1190 Target: | 5'-TCTCAACGACAGCAGCTCGCCCAAGTC-3' | (SEQ ID NO: 890) |
|  | 5'-CAACGACAGCAGCUCGCCCAAGUcc-3' | (SEQ ID NO: 237) |
|  | 3'-GAGUUGCUGUCGUCGAGCGGGUUCAGG-5' | (SEQ ID NO: 564) |
| MYC-1191 Target: | 5'-CTCAACGACAGCAGCTCGCCCAAGTCC-3' | (SEQ ID NO: 891) |
|  | 5'-AACGACAGCAGCUCGCCCAAGUCct-3' | (SEQ ID NO: 238) |
|  | 3'-AGUUGCUGUCGUCGAGCGGGUUCAGGA-5' | (SEQ ID NO: 565) |
| MYC-1192 Target: | 5'-TCAACGACAGCAGCTCGCCCAAGTCCT-3' | (SEQ ID NO: 892) |
|  | 5'-ACGACAGCAGCUCGCCCAAGUCCtg-3' | (SEQ ID NO: 239) |
|  | 3'-GUUGCUGUCGUCGAGCGGGUUCAGGAC-5' | (SEQ ID NO: 566) |
| MYC-1193 Target: | 5'-CAACGACAGCAGCTCGCCCAAGTCCTG-3' | (SEQ ID NO: 893) |
|  | 5'-CAUGAGGAGACACCGCCCACCACca-3' | (SEQ ID NO: 240) |
|  | 3'-AGGUACUCCUCUGUGGCGGGUGGUGGU-5' | (SEQ ID NO: 567) |
| MYC-1315 Target: | 5'-TCCATGAGGAGACACCGCCCACCACCA-3' | (SEQ ID NO: 894) |
|  | 5'-AUGAGGAGACACCGCCCACCACCag-3' | (SEQ ID NO: 241) |
|  | 3'-GGUACUCCUCUGUGGCGGGUGGUGGUC-5' | (SEQ ID NO: 568) |
| MYC-1316 Target: | 5'-CCATGAGGAGACACCGCCCACCACCAG-3' | (SEQ ID NO: 895) |
|  | 5'-UGAGGAGACACCGCCCACCACCAgc-3' | (SEQ ID NO: 242) |
|  | 3'-GUACUCCUCUGUGGCGGGUGGUGGUCG-5' | (SEQ ID NO: 569) |
| MYC-1317 Target: | 5'-CATGAGGAGACACCGCCCACCACCAGC-3' | (SEQ ID NO: 896) |

TABLE 2-continued

Selected Human Anti-MYC DsiRNA Agents (Asymmetrics)

|  |  |  |
|---|---|---|
|  | 5'-GAGGAGACACCGCCCACCACCAGca-3' | (SEQ ID NO: 243) |
|  | 3'-<u>UAC</u>UCCUCUGUGGCGGGUGGUGGUCG<u>U</u>-5' | (SEQ ID NO: 570) |
| MYC-1318 Target: | 5'-ATGAGGAGACACCGCCCACCACCAGCA-3' | (SEQ ID NO: 897) |
|  | 5'-AGGAGACACCGCCCACCACCAGCag-3' | (SEQ ID NO: 244) |
|  | 3'-<u>ACU</u>CCUCUGUGGCGGGUGGUGGUCG<u>UC</u>-5' | (SEQ ID NO: 571) |
| MYC-1319 Target: | 5'-TGAGGAGACACCGCCCACCACCAGCAG-3' | (SEQ ID NO: 898) |
|  | 5'-GGAGACACCGCCCACCACCAGCAgc-3' | (SEQ ID NO: 245) |
|  | 3'-<u>CUC</u>CUCUGUGGCGGGUGGUGGUCGU<u>CG</u>-5' | (SEQ ID NO: 572) |
| MYC-1320 Target: | 5'-GAGGAGACACCGCCCACCACCAGCAGC-3' | (SEQ ID NO: 899) |
|  | 5'-GAGACACCGCCCACCACCAGCAGcg-3' | (SEQ ID NO: 246) |
|  | 3'-<u>UCC</u>UCUGUGGCGGGUGGUGGUCGUC<u>GC</u>-5' | (SEQ ID NO: 573) |
| MYC-1321 Target: | 5'-AGGAGACACCGCCCACCACCAGCAGCG-3' | (SEQ ID NO: 900) |
|  | 5'-AGACACCGCCCACCACCAGCAGCga-3' | (SEQ ID NO: 247) |
|  | 3'-<u>CCU</u>CUGUGGCGGGUGGUGGUCGUCG<u>CU</u>-5' | (SEQ ID NO: 574) |
| MYC-1322 Target: | 5'-GGAGACACCGCCCACCACCAGCAGCGA-3' | (SEQ ID NO: 901) |
|  | 5'-GACACCGCCCACCACCAGCAGCGac-3' | (SEQ ID NO: 248) |
|  | 3'-<u>CUC</u>UGUGGCGGGUGGUGGUCGUCGC<u>UG</u>-5' | (SEQ ID NO: 575) |
| MYC-1323 Target: | 5'-GAGACACCGCCCACCACCAGCAGCGAC-3' | (SEQ ID NO: 902) |
|  | 5'-ACACCGCCCACCACCAGCAGCGAct-3' | (SEQ ID NO: 249) |
|  | 3'-<u>UCU</u>GUGGCGGGUGGUGGUCGUCGCU<u>GA</u>-5' | (SEQ ID NO: 576) |
| MYC-1324 Target: | 5'-AGACACCGCCCACCACCAGCAGCGACT-3' | (SEQ ID NO: 903) |
|  | 5'-CACCGCCCACCACCAGCAGCGACtc-3' | (SEQ ID NO: 250) |
|  | 3'-<u>CUG</u>UGGCGGGUGGUGGUCGUCGCUG<u>AG</u>-5' | (SEQ ID NO: 577) |
| MYC-1325 Target: | 5'-GACACCGCCCACCACCAGCAGCGACTC-3' | (SEQ ID NO: 904) |
|  | 5'-ACCGCCCACCACCAGCAGCGACUct-3' | (SEQ ID NO: 251) |
|  | 3'-<u>UGU</u>GGCGGGUGGUGGUCGUCGCUGA<u>GA</u>-5' | (SEQ ID NO: 578) |
| MYC-1326 Target: | 5'-ACACCGCCCACCACCAGCAGCGACTCT-3' | (SEQ ID NO: 905) |
|  | 5'-CCGCCCACCACCAGCAGCGACUCtg-3' | (SEQ ID NO: 252) |
|  | 3'-<u>GUG</u>GCGGGUGGUGGUCGUCGCUGAG<u>AC</u>-5' | (SEQ ID NO: 579) |
| MYC-1327 Target: | 5'-CACCGCCCACCACCAGCAGCGACTCTG-3' | (SEQ ID NO: 906) |
|  | 5'-CGCCCACCACCAGCAGCGACUCUga-3' | (SEQ ID NO: 253) |
|  | 3'-<u>UGG</u>CGGGUGGUGGUCGUCGCUGAGA<u>CU</u>-5' | (SEQ ID NO: 580) |
| MYC-1328 Target: | 5'-ACCGCCCACCACCAGCAGCGACTCTGA-3' | (SEQ ID NO: 907) |

TABLE 2-continued

Selected Human Anti-MYC DsiRNA Agents (Asymmetrics)

|  |  |  |
|---|---|---|
|  | 5'-GCCCACCACCAGCAGCGACUCUGag-3' | (SEQ ID NO: 254) |
|  | 3'-GGCGGGUGGUGGUCGUCGCUGAGACUC-5' | (SEQ ID NO: 581) |
| MYC-1329 Target: | 5'-CCGCCCACCACCAGCAGCGACTCTGAG-3' | (SEQ ID NO: 908) |
|  | 5'-CCCACCACCAGCAGCGACUCUGAgg-3' | (SEQ ID NO: 255) |
|  | 3'-GCGGGUGGUGGUCGUCGCUGAGACUCC-5' | (SEQ ID NO: 582) |
| MYC-1330 Target: | 5'-CGCCCACCACCAGCAGCGACTCTGAGG-3' | (SEQ ID NO: 909) |
|  | 5'-CCACCACCAGCAGCGACUCUGAGga-3' | (SEQ ID NO: 256) |
|  | 3'-CGGGUGGUGGUCGUCGCUGAGACUCCU-5' | (SEQ ID NO: 583) |
| MYC-1331 Target: | 5'-GCCCACCACCAGCAGCGACTCTGAGGA-3' | (SEQ ID NO: 910) |
|  | 5'-CACCACCAGCAGCGACUCUGAGGag-3' | (SEQ ID NO: 257) |
|  | 3'-GGGUGGUGGUCGUCGCUGAGACUCCUC-5' | (SEQ ID NO: 584) |
| MYC-1332 Target: | 5'-CCCACCACCAGCAGCGACTCTGAGGAG-3' | (SEQ ID NO: 911) |
|  | 5'-ACCACCAGCAGCGACUCUGAGGAgg-3' | (SEQ ID NO: 258) |
|  | 3'-GGUGGUGGUCGUCGCUGAGACUCCUCC-5' | (SEQ ID NO: 585) |
| MYC-1333 Target: | 5'-CCACCACCAGCAGCGACTCTGAGGAGG-3' | (SEQ ID NO: 912) |
|  | 5'-CCACCAGCAGCGACUCUGAGGAGga-3' | (SEQ ID NO: 259) |
|  | 3'-GUGGUGGUCGUCGCUGAGACUCCUCCU-5' | (SEQ ID NO: 586) |
| MYC-1334 Target: | 5'-CACCACCAGCAGCGACTCTGAGGAGGA-3' | (SEQ ID NO: 913) |
|  | 5'-CAAGAAGAUGAGGAAGAAAUCGAtg-3' | (SEQ ID NO: 260) |
|  | 3'-UUGUUCUUCUACUCCUUCUUUAGCUAC-5' | (SEQ ID NO: 587) |
| MYC-1360 Target: | 5'-AACAAGAAGATGAGGAAGAAATCGATG-3' | (SEQ ID NO: 914) |
|  | 5'-AAGAAGAUGAGGAAGAAAUCGAUgt-3' | (SEQ ID NO: 261) |
|  | 3'-UGUUCUUCUACUCCUUCUUUAGCUACA-5' | (SEQ ID NO: 588) |
| MYC-1361 Target: | 5'-ACAAGAAGATGAGGAAGAAATCGATGT-3' | (SEQ ID NO: 915) |
|  | 5'-GAGGCCACAGCAAACCUCCUCACag-3' | (SEQ ID NO: 262) |
|  | 3'-ACCUCCGGUGUCGUUUGGAGGAGUGUC-5' | (SEQ ID NO: 589) |
| MYC-1448 Target: | 5'-TGGAGGCCACAGCAAACCTCCTCACAG-3' | (SEQ ID NO: 916) |
|  | 5'-CACAGCCCACUGGUCCUCAAGAGgt-3' | (SEQ ID NO: 263) |
|  | 3'-GAGUGUCGGGUGACCAGGAGUUCUCCA-5' | (SEQ ID NO: 590) |
| MYC-1468 Target: | 5'-CTCACAGCCCACTGGTCCTCAAGAGGT-3' | (SEQ ID NO: 917) |
|  | 5'-ACAGCCCACUGGUCCUCAAGAGGtg-3' | (SEQ ID NO: 264) |
|  | 3'-AGUGUCGGGUGACCAGGAGUUCUCCAC-5' | (SEQ ID NO: 591) |
| MYC-1469 Target: | 5'-TCACAGCCCACTGGTCCTCAAGAGGTG-3' | (SEQ ID NO: 918) |

TABLE 2-continued

Selected Human Anti-MYC DsiRNA Agents (Asymmetrics)

|  |  |  |
|---|---|---|
|  | 5'-CAGCCCACUGGUCCUCAAGAGGUgc-3' | (SEQ ID NO: 265) |
|  | 3'-<u>GUG</u>UCGGGUGACCAGGAGUUCUCCA<u>CG</u>-5' | (SEQ ID NO: 592) |
| MYC-1470 Target: | 5'-CACAGCCCACTGGTCCTCAAGAGGTGC-3' | (SEQ ID NO: 919) |
|  | 5'-AGCCCACUGGUCCUCAAGAGGUGcc-3' | (SEQ ID NO: 266) |
|  | 3'-<u>UGU</u>CGGGUGACCAGGAGUUCUCCAC<u>GG</u>-5' | (SEQ ID NO: 593) |
| MYC-1471 Target: | 5'-ACAGCCCACTGGTCCTCAAGAGGTGCC-3' | (SEQ ID NO: 920) |
|  | 5'-GCCCACUGGUCCUCAAGAGGUGCca-3' | (SEQ ID NO: 267) |
|  | 3'-<u>GUC</u>GGGUGACCAGGAGUUCUCCACG<u>GU</u>-5' | (SEQ ID NO: 594) |
| MYC-1472 Target: | 5'-CAGCCCACTGGTCCTCAAGAGGTGCCA-3' | (SEQ ID NO: 921) |
|  | 5'-CCCACUGGUCCUCAAGAGGUGCCac-3' | (SEQ ID NO: 268) |
|  | 3'-<u>UCG</u>GGUGACCAGGAGUUCUCCACGG<u>UG</u>-5' | (SEQ ID NO: 595) |
| MYC-1473 Target: | 5'-AGCCCACTGGTCCTCAAGAGGTGCCAC-3' | (SEQ ID NO: 922) |
|  | 5'-CCACUGGUCCUCAAGAGGUGCCAcg-3' | (SEQ ID NO: 269) |
|  | 3'-<u>CGG</u>GUGACCAGGAGUUCUCCACGGU<u>GC</u>-5' | (SEQ ID NO: 596) |
| MYC-1474 Target: | 5'-GCCCACTGGTCCTCAAGAGGTGCCACG-3' | (SEQ ID NO: 923) |
|  | 5'-CACUGGUCCUCAAGAGGUGCCACgt-3' | (SEQ ID NO: 270) |
|  | 3'-<u>GGG</u>UGACCAGGAGUUCUCCACGGUG<u>CA</u>-5' | (SEQ ID NO: 597) |
| MYC-1475 Target: | 5'-CCCACTGGTCCTCAAGAGGTGCCACGT-3' | (SEQ ID NO: 924) |
|  | 5'-ACUGGUCCUCAAGAGGUGCCACGtc-3' | (SEQ ID NO: 271) |
|  | 3'-<u>GGU</u>GACCAGGAGUUCUCCACGGUGC<u>AG</u>-5' | (SEQ ID NO: 598) |
| MYC-1476 Target: | 5'-CCACTGGTCCTCAAGAGGTGCCACGTC-3' | (SEQ ID NO: 925) |
|  | 5'-CUGGUCCUCAAGAGGUGCCACGUct-3' | (SEQ ID NO: 272) |
|  | 3'-<u>GUG</u>ACCAGGAGUUCUCCACGGUGC<u>AGA</u>-5' | (SEQ ID NO: 599) |
| MYC-1477 Target: | 5'-CACTGGTCCTCAAGAGGTGCCACGTCT-3' | (SEQ ID NO: 926) |
|  | 5'-UGGUCCUCAAGAGGUGCCACGUCtc-3' | (SEQ ID NO: 273) |
|  | 3'-<u>UGA</u>CCAGGAGUUCUCCACGGUGCAG<u>AG</u>-5' | (SEQ ID NO: 600) |
| MYC-1478 Target: | 5'-ACTGGTCCTCAAGAGGTGCCACGTCTC-3' | (SEQ ID NO: 927) |
|  | 5'-GGUCCUCAAGAGGUGCCACGUCUcc-3' | (SEQ ID NO: 274) |
|  | 3'-<u>GAC</u>CAGGAGUUCUCCACGGUGCAGA<u>GG</u>-5' | (SEQ ID NO: 601) |
| MYC-1479 Target: | 5'-CTGGTCCTCAAGAGGTGCCACGTCTCC-3' | (SEQ ID NO: 928) |
|  | 5'-GUCCUCAAGAGGUGCCACGUCUCca-3' | (SEQ ID NO: 275) |
|  | 3'-<u>ACC</u>AGGAGUUCUCCACGGUGCAGAG<u>GU</u>-5' | (SEQ ID NO: 602) |
| MYC-1480 Target: | 5'-TGGTCCTCAAGAGGTGCCACGTCTCCA-3' | (SEQ ID NO: 929) |

TABLE 2-continued

Selected Human Anti-MYC DsiRNA Agents (Asymmetrics)

|  |  |  |
|---|---|---|
|  | 5'-UCCUCAAGAGGUGCCACGUCUCCac-3' | (SEQ ID NO: 276) |
|  | 3'-<u>CC</u>AGGAGUUCUCCACGGUGCAGAGG<u>UG</u>-5' | (SEQ ID NO: 603) |
| MYC-1481 Target: | 5'-GGTCCTCAAGAGGTGCCACGTCTCCAC-3' | (SEQ ID NO: 930) |
|  | 5'-CCUCAAGAGGUGCCACGUCUCCAca-3' | (SEQ ID NO: 277) |
|  | 3'-<u>C</u>AGGAGUUCUCCACGGUGCAGAGGU<u>GU</u>-5' | (SEQ ID NO: 604) |
| MYC-1482 Target: | 5'-GTCCTCAAGAGGTGCCACGTCTCCACA-3' | (SEQ ID NO: 931) |
|  | 5'-CUCAAGAGGUGCCACGUCUCCACac-3' | (SEQ ID NO: 278) |
|  | 3'-<u>A</u>GGAGUUCUCCACGGUGCAGAGGUG<u>UG</u>-5' | (SEQ ID NO: 605) |
| MYC-1483 Target: | 5'-TCCTCAAGAGGTGCCACGTCTCCACAC-3' | (SEQ ID NO: 932) |
|  | 5'-AGCUUUUUUGCCCUGCGUGACCAga-3' | (SEQ ID NO: 279) |
|  | 3'-<u>CC</u>UCGAAAAAACGGGACGCACUGGUC<u>U</u>-5' | (SEQ ID NO: 606) |
| MYC-1711 Target: | 5'-GGAGCTTTTTTGCCCTGCGTGACCAGA-3' | (SEQ ID NO: 933) |
|  | 5'-GCUUUUUUGCCCUGCGUGACCAGat-3' | (SEQ ID NO: 280) |
|  | 3'-<u>C</u>UCGAAAAAACGGGACGCACUGGUCU<u>A</u>-5' | (SEQ ID NO: 607) |
| MYC-1712 Target: | 5'-GAGCTTTTTTGCCCTGCGTGACCAGAT-3' | (SEQ ID NO: 934) |
|  | 5'-CUUUUUUGCCCUGCGUGACCAGAtc-3' | (SEQ ID NO: 281) |
|  | 3'-<u>U</u>CGAAAAAACGGGACGCACUGGUCU<u>AG</u>-5' | (SEQ ID NO: 608) |
| MYC-1713 Target: | 5'-AGCTTTTTTGCCCTGCGTGACCAGATC-3' | (SEQ ID NO: 935) |
|  | 5'-UUUUUUGCCCUGCGUGACCAGAUcc-3' | (SEQ ID NO: 282) |
|  | 3'-<u>C</u>GAAAAAACGGGACGCACUGGUCUA<u>GG</u>-5' | (SEQ ID NO: 609) |
| MYC-1714 Target: | 5'-GCTTTTTTGCCCTGCGTGACCAGATCC-3' | (SEQ ID NO: 936) |
|  | 5'-UUUUUGCCCUGCGUGACCAGAUCcc-3' | (SEQ ID NO: 283) |
|  | 3'-<u>G</u>AAAAAACGGGACGCACUGGUCUAG<u>GG</u>-5' | (SEQ ID NO: 610) |
| MYC-1715 Target: | 5'-CTTTTTTGCCCTGCGTGACCAGATCCC-3' | (SEQ ID NO: 937) |
|  | 5'-UUUUGCCCUGCGUGACCAGAUCCcg-3' | (SEQ ID NO: 284) |
|  | 3'-<u>A</u>AAAAACGGGACGCACUGGUCUAGG<u>GC</u>-5' | (SEQ ID NO: 611) |
| MYC-1716 Target: | 5'-TTTTTTGCCCTGCGTGACCAGATCCCG-3' | (SEQ ID NO: 938) |
|  | 5'-UUUGCCCUGCGUGACCAGAUCCCgg-3' | (SEQ ID NO: 285) |
|  | 3'-<u>A</u>AAAACGGGACGCACUGGUCUAGGG<u>CC</u>-5' | (SEQ ID NO: 612) |
| MYC-1717 Target: | 5'-TTTTTGCCCTGCGTGACCAGATCCCGG-3' | (SEQ ID NO: 939) |
|  | 5'-UUGCCCUGCGUGACCAGAUCCCGga-3' | (SEQ ID NO: 286) |
|  | 3'-<u>A</u>AAACGGGACGCACUGGUCUAGGGC<u>CU</u>-5' | (SEQ ID NO: 613) |
| MYC-1718 Target: | 5'-TTTTGCCCTGCGTGACCAGATCCCGGA-3' | (SEQ ID NO: 940) |

TABLE 2-continued

Selected Human Anti-MYC DsiRNA Agents (Asymmetrics)

| | | |
|---|---|---|
| | 5'-UGCCCUGCGUGACCAGAUCCCGGag-3' | (SEQ ID NO: 287) |
| | 3'-<u>AAA</u>CGGGACGCACUGGUCUAGGGCC<u>UC</u>-5' | (SEQ ID NO: 614) |
| MYC-1719 Target: | 5'-TTTGCCCTGCGTGACCAGATCCCGGAG-3' | (SEQ ID NO: 941) |
| | 5'-GCCCUGCGUGACCAGAUCCCGGAgt-3' | (SEQ ID NO: 288) |
| | 3'-<u>AAC</u>GGGACGCACUGGUCUAGGGCCU<u>CA</u>-5' | (SEQ ID NO: 615) |
| MYC-1720 Target: | 5'-TTGCCCTGCGTGACCAGATCCCGGAGT-3' | (SEQ ID NO: 942) |
| | 5'-CCCUGCGUGACCAGAUCCCGGAGtt-3' | (SEQ ID NO: 289) |
| | 3'-<u>ACG</u>GGACGCACUGGUCUAGGGCCUC<u>AA</u>-5' | (SEQ ID NO: 616) |
| MYC-1721 Target: | 5'-TGCCCTGCGTGACCAGATCCCGGAGTT-3' | (SEQ ID NO: 943) |
| | 5'-GGAAACGACGAGAACAGUUGAAAca-3' | (SEQ ID NO: 290) |
| | 3'-<u>CGC</u>CUUUGCUGCUCUUGUCAACUUUG<u>U</u>-5' | (SEQ ID NO: 617) |
| MYC-1856 Target: | 5'-GCGGAAACGACGAGAACAGTTGAAACA-3' | (SEQ ID NO: 944) |
| | 5'-GAAACGACGAGAACAGUUGAAACac-3' | (SEQ ID NO: 291) |
| | 3'-<u>GCC</u>UUUGCUGCUCUUGUCAACUUUG<u>UG</u>-5' | (SEQ ID NO: 618) |
| MYC-1857 Target: | 5'-CGGAAACGACGAGAACAGTTGAAACAC-3' | (SEQ ID NO: 945) |
| | 5'-UUUAACAGAUUUGUAUUUAAGAAtt-3' | (SEQ ID NO: 292) |
| | 3'-<u>AGA</u>AAUUGUCUAAACAUAAAUUCUU<u>AA</u>-5' | (SEQ ID NO: 619) |
| MYC-2115 Target: | 5'-TCTTTAACAGATTTGTATTTAAGAATT-3' | (SEQ ID NO: 946) |
| | 5'-UUAACAGAUUUGUAUUUAAGAAUtg-3' | (SEQ ID NO: 293) |
| | 3'-<u>GAA</u>AUUGUCUAAACAUAAAUUCUUA<u>AC</u>-5' | (SEQ ID NO: 620) |
| MYC-2116 Target: | 5'-CTTTAACAGATTTGTATTTAAGAATTG-3' | (SEQ ID NO: 947) |
| | 5'-AAAUGUAAAUAACUUUAAUAAAAcg-3' | (SEQ ID NO: 294) |
| | 3'-<u>AAU</u>UUACAUUUAUUGAAAUUAUUUU<u>GC</u>-5' | (SEQ ID NO: 621) |
| MYC-2193 Target: | 5'-TTAAATGTAAATAACTTTAATAAAACG-3' | (SEQ ID NO: 948) |
| | 5'-AAUGUAAAUAACUUUAAUAAAACgt-3' | (SEQ ID NO: 295) |
| | 3'-<u>AUU</u>UACAUUUAUUGAAAUUAUUUUG<u>CA</u>-5' | (SEQ ID NO: 622) |
| MYC-2194 Target: | 5'-TAAATGTAAATAACTTTAATAAAACGT-3' | (SEQ ID NO: 949) |
| | 5'-AUGUAAAUAACUUUAAUAAAACGtt-3' | (SEQ ID NO: 296) |
| | 3'-<u>UUU</u>ACAUUUAUUGAAAUUAUUUUGC<u>AA</u>-5' | (SEQ ID NO: 623) |
| MYC-2195 Target: | 5'-AAATGTAAATAACTTTAATAAAACGTT-3' | (SEQ ID NO: 950) |
| | 5'-UGUAAAUAACUUUAAUAAAACGUtt-3' | (SEQ ID NO: 297) |
| | 3'-<u>UUA</u>CAUUUAUUGAAAUUAUUUUGCA<u>AA</u>-5' | (SEQ ID NO: 624) |
| MYC-2196 Target: | 5'-AATGTAAATAACTTTAATAAAACGTTT-3' | (SEQ ID NO: 951) |

TABLE 2-continued

Selected Human Anti-MYC DsiRNA Agents (Asymmetrics)

|  |  |
|---|---|
|  | 5'-GUAAAUAACUUUAAUAAAACGUUta-3' (SEQ ID NO: 298) |
|  | 3'-UACAUUUAUUGAAAUUAUUUUGCAAAU-5' (SEQ ID NO: 625) |
| MYC-2197 Target: | 5'-ATGTAAATAACTTTAATAAAACGTTTA-3' (SEQ ID NO: 952) |
|  | 5'-UAAAUAACUUUAAUAAAACGUUUat-3' (SEQ ID NO: 299) |
|  | 3'-ACAUUUAUUGAAAUUAUUUUGCAAAUA-5' (SEQ ID NO: 626) |
| MYC-2198 Target: | 5'-TGTAAATAACTTTAATAAAACGTTTAT-3' (SEQ ID NO: 953) |
|  | 5'-AAAUAACUUUAAUAAAACGUUUAta-3' (SEQ ID NO: 300) |
|  | 3'-CAUUUAUUGAAAUUAUUUUGCAAAUAU-5' (SEQ ID NO: 627) |
| MYC-2199 Target: | 5'-GTAAATAACTTTAATAAAACGTTTATA-3' (SEQ ID NO: 954) |
|  | 5'-AAUAACUUUAAUAAAACGUUUAUag-3' (SEQ ID NO: 301) |
|  | 3'-AUUUAUUGAAAUUAUUUUGCAAAUAUC-5' (SEQ ID NO: 628) |
| MYC-2200 Target: | 5'-TAAATAACTTTAATAAAACGTTTATAG-3' (SEQ ID NO: 955) |
|  | 5'-AUAACUUUAAUAAAACGUUUAUAgc-3' (SEQ ID NO: 302) |
|  | 3'-UUUAUUGAAAUUAUUUUGCAAAUAUCG-5' (SEQ ID NO: 629) |
| MYC-2201 Target: | 5'-AAATAACTTTAATAAAACGTTTATAGC-3' (SEQ ID NO: 956) |
|  | 5'-UAACUUUAAUAAAACGUUUAUAGca-3' (SEQ ID NO: 303) |
|  | 3'-UUAUUGAAAUUAUUUUGCAAAUAUCGU-5' (SEQ ID NO: 630) |
| MYC-2202 Target: | 5'-AATAACTTTAATAAAACGTTTATAGCA-3' (SEQ ID NO: 957) |
|  | 5'-AACUUUAAUAAAACGUUUAUAGCag-3' (SEQ ID NO: 304) |
|  | 3'-UAUUGAAAUUAUUUUGCAAAUAUCGUC-5' (SEQ ID NO: 631) |
| MYC-2203 Target: | 5'-ATAACTTTAATAAAACGTTTATAGCAG-3' (SEQ ID NO: 958) |
|  | 5'-ACUUUAAUAAAACGUUUAUAGCAgt-3' (SEQ ID NO: 305) |
|  | 3'-AUUGAAAUUAUUUUGCAAAUAUCGUCA-5' (SEQ ID NO: 632) |
| MYC-2204 Target: | 5'-TAACTTTAATAAAACGTTTATAGCAGT-3' (SEQ ID NO: 959) |
|  | 5'-CUUUAAUAAAACGUUUAUAGCAGtt-3' (SEQ ID NO: 306) |
|  | 3'-UUGAAAUUAUUUUGCAAAUAUCGUCAA-5' (SEQ ID NO: 633) |
| MYC-2205 Target: | 5'-AACTTTAATAAAACGTTTATAGCAGTT-3' (SEQ ID NO: 960) |
|  | 5'-UUUUUAAAGUUGAUUUUUUUCUAtt-3' (SEQ ID NO: 307) |
|  | 3'-CGAAAAAUUUCAACUAAAAAAAGAUAA-5' (SEQ ID NO: 634) |
| MYC-2313 Target: | 5'-GCTTTTTAAAGTTGATTTTTTTCTATT-3' (SEQ ID NO: 961) |
|  | 5'-UUUUAAAGUUGAUUUUUUUCUAUtg-3' (SEQ ID NO: 308) |
|  | 3'-GAAAAAUUUCAACUAAAAAAAGAUAAC-5' (SEQ ID NO: 635) |
| MYC-2314 Target: | 5'-CTTTTTAAAGTTGATTTTTTTCTATTG-3' (SEQ ID NO: 962) |

TABLE 2-continued

Selected Human Anti-MYC DsiRNA Agents (Asymmetrics)

|               |                                                              |
|---------------|--------------------------------------------------------------|
|               | 5'-UUUAAAGUUGAUUUUUUCUAUUgt-3'   (SEQ ID NO: 309)            |
|               | 3'-<u>AAA</u>AAUUUCAACUAAAAAAGAUAA<u>CA</u>-5' (SEQ ID NO: 636) |
| MYC-2315 Target: | 5'-TTTTTAAAGTTGATTTTTTCTATTGT-3'   (SEQ ID NO: 963)        |
|               | 5'-UUAAAGUUGAUUUUUUCUAUUGtt-3'    (SEQ ID NO: 310)           |
|               | 3'-<u>AAA</u>AUUUCAACUAAAAAAGAUAAC<u>AA</u>-5' (SEQ ID NO: 637) |
| MYC-2316 Target: | 5'-TTTTAAAGTTGATTTTTTCTATTGTT-3'   (SEQ ID NO: 964)        |
|               | 5'-UAAAGUUGAUUUUUUCUAUUGUtt-3'    (SEQ ID NO: 311)           |
|               | 3'-<u>AAA</u>UUUCAACUAAAAAAGAUAACA<u>AA</u>-5' (SEQ ID NO: 638) |
| MYC-2317 Target: | 5'-TTTAAAGTTGATTTTTTCTATTGTTT-3'   (SEQ ID NO: 965)        |
|               | 5'-AAAGUUGAUUUUUUCUAUUGUUtt-3'    (SEQ ID NO: 312)           |
|               | 3'-<u>AA</u>UUUCAACUAAAAAAGAUAACA<u>AAA</u>-5' (SEQ ID NO: 639) |
| MYC-2318 Target: | 5'-TTAAAGTTGATTTTTTCTATTGTTTT-3'   (SEQ ID NO: 966)        |
|               | 5'-AAGUUGAUUUUUUCUAUUGUUUtt-3'    (SEQ ID NO: 313)           |
|               | 3'-<u>A</u>UUUCAACUAAAAAAGAUAACAAA<u>AA</u>-5' (SEQ ID NO: 640) |
| MYC-2319 Target: | 5'-TAAAGTTGATTTTTTCTATTGTTTTT-3'   (SEQ ID NO: 967)        |
|               | 5'-AGUUGAUUUUUUCUAUUGUUUUta-3'    (SEQ ID NO: 314)           |
|               | 3'-<u>UUU</u>CAACUAAAAAAGAUAACAAAA<u>AU</u>-5' (SEQ ID NO: 641) |
| MYC-2320 Target: | 5'-AAAGTTGATTTTTTCTATTGTTTTTA-3'   (SEQ ID NO: 968)        |
|               | 5'-GUUGAUUUUUUCUAUUGUUUUUag-3'    (SEQ ID NO: 315)           |
|               | 3'-<u>UUC</u>AACUAAAAAAGAUAACAAAAA<u>UC</u>-5' (SEQ ID NO: 642) |
| MYC-2321 Target: | 5'-AAGTTGATTTTTTCTATTGTTTTTAG-3'   (SEQ ID NO: 969)        |
|               | 5'-UUGAUUUUUUCUAUUGUUUUUAga-3'    (SEQ ID NO: 316)           |
|               | 3'-<u>UCA</u>ACUAAAAAAGAUAACAAAAAU<u>CU</u>-5' (SEQ ID NO: 643) |
| MYC-2322 Target: | 5'-AGTTGATTTTTTCTATTGTTTTTAGA-3'   (SEQ ID NO: 970)        |
|               | 5'-UGAUUUUUUCUAUUGUUUUUAGaa-3'    (SEQ ID NO: 317)           |
|               | 3'-<u>CAA</u>CUAAAAAAGAUAACAAAAAUC<u>UU</u>-5' (SEQ ID NO: 644) |
| MYC-2323 Target: | 5'-GTTGATTTTTTCTATTGTTTTTAGAA-3'   (SEQ ID NO: 971)        |
|               | 5'-GAUUUUUUCUAUUGUUUUUAGAaa-3'    (SEQ ID NO: 318)           |
|               | 3'-<u>AAC</u>UAAAAAAGAUAACAAAAAUCU<u>UU</u>-5' (SEQ ID NO: 645) |
| MYC-2324 Target: | 5'-TTGATTTTTTCTATTGTTTTTAGAAA-3'   (SEQ ID NO: 972)        |
|               | 5'-AUUUUUUCUAUUGUUUUUAGAAaa-3'    (SEQ ID NO: 319)           |
|               | 3'-<u>ACU</u>AAAAAAGAUAACAAAAAUCU<u>UUU</u>-5' (SEQ ID NO: 646) |
| MYC-2325 Target: | 5'-TGATTTTTTCTATTGTTTTTAGAAAA-3'   (SEQ ID NO: 973)        |

TABLE 2-continued

Selected Human Anti-MYC DsiRNA Agents (Asymmetrics)

|  |  |  |
|---|---|---|
|  | 5'-UUUUUUUCUAUUGUUUUUAGAAAaa-3' | (SEQ ID NO: 320) |
|  | 3'-<u>CUA</u>AAAAAAGAUAACAAAAAUCUUU<u>UU</u>-5' | (SEQ ID NO: 647) |
| MYC-2326 Target: | 5'-GATTTTTTCTATTGTTTTTAGAAAAA-3' | (SEQ ID NO: 974) |
|  | 5'-UUUUUUCUAUUGUUUUUAGAAAAaa-3' | (SEQ ID NO: 321) |
|  | 3'-<u>UAA</u>AAAAAGAUAACAAAAAUCUUUU<u>UU</u>-5' | (SEQ ID NO: 648) |
| MYC-2327 Target: | 5'-ATTTTTTTCTATTGTTTTTAGAAAAAA-3' | (SEQ ID NO: 975) |
|  | 5'-UUUUUCUAUUGUUUUUAGAAAAAat-3' | (SEQ ID NO: 322) |
|  | 3'-<u>AAA</u>AAAAGAUAACAAAAAUCUUUUU<u>UA</u>-5' | (SEQ ID NO: 649) |
| MYC-2328 Target: | 5'-TTTTTTTCTATTGTTTTTAGAAAAAAT-3' | (SEQ ID NO: 976) |
|  | 5'-UUUUCUAUUGUUUUUAGAAAAAAta-3' | (SEQ ID NO: 323) |
|  | 3'-<u>AAA</u>AAAGAUAACAAAAAUCUUUUUU<u>AU</u>-5' | (SEQ ID NO: 650) |
| MYC-2329 Target: | 5'-TTTTTTCTATTGTTTTTAGAAAAAATA-3' | (SEQ ID NO: 977) |
|  | 5'-UUUCUAUUGUUUUUAGAAAAAAUaa-3' | (SEQ ID NO: 324) |
|  | 3'-<u>AAA</u>AAGAUAACAAAAAUCUUUUUUA<u>UU</u>-5' | (SEQ ID NO: 651) |
| MYC-2330 Target: | 5'-TTTTTCTATTGTTTTTAGAAAAAATAA-3' | (SEQ ID NO: 978) |
|  | 5'-UUCUAUUGUUUUUAGAAAAAAUAaa-3' | (SEQ ID NO: 325) |
|  | 3'-<u>AAA</u>AGAUAACAAAAAUCUUUUUUAU<u>UU</u>-5' | (SEQ ID NO: 652) |
| MYC-2331 Target: | 5'-TTTTCTATTGTTTTTAGAAAAAATAAA-3' | (SEQ ID NO: 979) |
|  | 5'-UCUAUUGUUUUUAGAAAAAAUAAaa-3' | (SEQ ID NO: 326) |
|  | 3'-<u>AAA</u>GAUAACAAAAAUCUUUUUUAUU<u>UU</u>-5' | (SEQ ID NO: 653) |
| MYC-2332 Target: | 5'-TTTCTATTGTTTTTAGAAAAAATAAAA-3' | (SEQ ID NO: 980) |
|  | 5'-CUAUUGUUUUUAGAAAAAAUAAAat-3' | (SEQ ID NO: 327) |
|  | 3'-<u>AAG</u>AUAACAAAAAUCUUUUUUAUUU<u>UA</u>-5' | (SEQ ID NO: 654) |
| MYC-2333 Target: | 5'-TTCTATTGTTTTTAGAAAAAATAAAT-3' | (SEQ ID NO: 981) |

TABLE 3

Selected Human Anti-MYC DsiRNAs, Unmodified Duplexes (Asymmetrics)

|  |  |  |
|---|---|---|
|  | 5'-CGAGAAGGGCAGGGCUUCUCAGAGG-3' | (SEQ ID NO: 982) |
|  | 3'-GAGCUCUUCCCGUCCCGAAGAGUCUCC-5' | (SEQ ID NO: 328) |
| MYC-94 Target: | 5'-CTCGAGAAGGGCAGGGCTTCTCAGAGG-3' | (SEQ ID NO: 655) |
|  | 5'-GCUUUAUCUAACUCGCUGUAGUAAU-3' | (SEQ ID NO: 983) |
|  | 3'-CCCGAAAUAGAUUGAGCGACAUCAUUA-5' | (SEQ ID NO: 329) |
| MYC-178 Target: | 5'-GGGCTTTATCTAACTCGCTGTAGTAAT-3' | (SEQ ID NO: 656) |
|  | 5'-CCCUUGCCGCAUCCACGAAACUUUG-3' | (SEQ ID NO: 984) |
|  | 3'-UUGGGAACGGCGUAGGUGCUUUGAAAC-5' | (SEQ ID NO: 330) |
| MYC-365 Target: | 5'-AACCCTTGCCGCATCCACGAAACTTTG-3' | (SEQ ID NO: 657) |

TABLE 3-continued

Selected Human Anti-MYC DsiRNAs, Unmodified Duplexes (Asymmetrics)

|  |  |  |  |
|---|---|---|---|
|  | 5'-GCCGCAUCCACGAAACUUUGCCCAU-3' | (SEQ ID NO: 985) |  |
|  | 3'-AACGGCGUAGGUGCUUUGAAACGGGUA-5' | (SEQ ID NO: 331) |  |
| MYC-370 Target: | 5'-TTGCCGCATCCACGAAACTTTGCCCAT-3' | (SEQ ID NO: 658) |  |
|  | 5'-UCCACGAAACUUUGCCCAUAGCAGC-3' | (SEQ ID NO: 986) |  |
|  | 3'-GUAGGUGCUUUGAAACGGGUAUCGUCG-5' | (SEQ ID NO: 332) |  |
| MYC-376 Target: | 5'-CATCCACGAAACTTTGCCCATAGCAGC-3' | (SEQ ID NO: 659) |  |
|  | 5'-GCGGGCACUUUGCACUGGAACUUAC-3' | (SEQ ID NO: 987) |  |
|  | 3'-CCCGCCCGUGAAACGUGACCUUGAAUG-5' | (SEQ ID NO: 333) |  |
| MYC-403 Target: | 5'-GGGCGGGCACTTTGCACTGGAACTTAC-3' | (SEQ ID NO: 660) |  |
|  | 5'-ACUUUGCACUGGAACUUACAACACC-3' | (SEQ ID NO: 988) |  |
|  | 3'-CGUGAAACGUGACCUUGAAUGUUGUGG-5' | (SEQ ID NO: 334) |  |
| MYC-409 Target: | 5'-GCACTTTGCACTGGAACTTACAACACC-3' | (SEQ ID NO: 661) |  |
|  | 5'-CUGGAACUUACAACACCCGAGCAAG-3' | (SEQ ID NO: 989) |  |
|  | 3'-GUGACCUUGAAUGUUGUGGGCUCGUUC-5' | (SEQ ID NO: 335) |  |
| MYC-417 Target: | 5'-CACTGGAACTTACAACACCCGAGCAAG-3' | (SEQ ID NO: 662) |  |
|  | 5'-GCAGCUGCUUAGACGCUGGAUUUUU-3' | (SEQ ID NO: 990) |  |
|  | 3'-AACGUCGACGAAUCUGCGACCUAAAAA-5' | (SEQ ID NO: 336) |  |
| MYC-535 Target: | 5'-TTGCAGCTGCTTAGACGCTGGATTTTT-3' | (SEQ ID NO: 663) |  |
|  | 5'-GCUUAGACGCUGGAUUUUUUUCGGG-3' | (SEQ ID NO: 991) |  |
|  | 3'-GACGAAUCUGCGACCUAAAAAAAGCCC-5' | (SEQ ID NO: 337) |  |
| MYC-541 Target: | 5'-CTGCTTAGACGCTGGATTTTTTTCGGG-3' | (SEQ ID NO: 664) |  |
|  | 5'-CGCUGGAUUUUUUUCGGGUAGUGGA-3' | (SEQ ID NO: 992) |  |
|  | 3'-CUGCGACCUAAAAAAAGCCCAUCACCU-5' | (SEQ ID NO: 338) |  |
| MYC-548 Target: | 5'-GACGCTGGATTTTTTTCGGGTAGTGGA-3' | (SEQ ID NO: 665) |  |
|  | 5'-GAUUUUUUUCGGGUAGUGGAAAACC-3' | (SEQ ID NO: 993) |  |
|  | 3'-ACCUAAAAAAAGCCCAUCACCUUUUGG-5' | (SEQ ID NO: 339) |  |
| MYC-553 Target: | 5'-TGGATTTTTTTCGGGTAGTGGAAAACC-3' | (SEQ ID NO: 666) |  |
|  | 5'-CGGGUAGUGGAAAACCAGCAGCCUC-3' | (SEQ ID NO: 994) |  |
|  | 3'-AAGCCCAUCACCUUUUGGUCGUCGGAG-5' | (SEQ ID NO: 340) |  |
| MYC-562 Target: | 5'-TTCGGGTAGTGGAAAACCAGCAGCCTC-3' | (SEQ ID NO: 667) |  |
|  | 5'-CUCAACGUUAGCUUCACCAACAGGA-3' | (SEQ ID NO: 995) |  |
|  | 3'-GGGAGUUGCAAUCGAAGUGGUUGUCCU-5' | (SEQ ID NO: 341) |  |
| MYC-601 Target: | 5'-CCCTCAACGTTAGCTTCACCAACAGGA-3' | (SEQ ID NO: 668) |  |
|  | 5'-GUUAGCUUCACCAACAGGAACUAUG-3' | (SEQ ID NO: 996) |  |
|  | 3'-UGCAAUCGAAGUGGUUGUCCUUGAUAC-5' | (SEQ ID NO: 342) |  |
| MYC-607 Target: | 5'-ACGTTAGCTTCACCAACAGGAACTATG-3' | (SEQ ID NO: 669) |  |
|  | 5'-GACUCGGUGCAGCCGUAUUUCUACU-3' | (SEQ ID NO: 997) |  |
|  | 3'-UGCUGAGCCACGUCGGCAUAAAGAUGA-5' | (SEQ ID NO: 343) |  |
| MYC-643 Target: | 5'-ACGACTCGGTGCAGCCGTATTTCTACT-3' | (SEQ ID NO: 670) |  |

TABLE 3-continued

Selected Human Anti-MYC DsiRNAs, Unmodified Duplexes (Asymmetrics)

```
                   5'-GCAGCCGUAUUUCUACUGCGACGAG-3'     (SEQ ID NO: 998)
                   3'-CACGUCGGCAUAAAGAUGACGCUGCUC-5'   (SEQ ID NO: 344)
MYC-651 Target:    5'-GTGCAGCCGTATTTCTACTGCGACGAG-3'   (SEQ ID NO: 671)
                   5'-GAGGAGAACUUCUACCAGCAGCAGC-3'     (SEQ ID NO: 999)
                   3'-UCCUCCUCUUGAAGAUGGUCGUCGUCG-5'   (SEQ ID NO: 345)
MYC-676 Target:    5'-AGGAGGAGAACTTCTACCAGCAGCAGC-3'   (SEQ ID NO: 672)
                   5'-GCGAGGAUAUCUGGAAGAAAUUCGA-3'     (SEQ ID NO: 1000)
                   3'-GUCGCUCCUAUAGACCUUCUUUAAGCU-5'   (SEQ ID NO: 346)
MYC-731 Target:    5'-CAGCGAGGATATCTGGAAGAAATTCGA-3'   (SEQ ID NO: 673)
                   5'-CGUUGCGGUCACACCCUUCUCCCUU-3'     (SEQ ID NO: 1001)
                   3'-AUGCAACGCCAGUGUGGGAAGAGGGAA-5'   (SEQ ID NO: 347)
MYC-816 Target:    5'-TACGTTGCGGTCACACCCTTCTCCCTT-3'   (SEQ ID NO: 674)
                   5'-ACAUGGUGAACCAGAGUUUCAUCUG-3'     (SEQ ID NO: 1002)
                   3'-UCUGUACCACUUGGUCUCAAAGUAGAC-5'   (SEQ ID NO: 348)
MYC-920 Target:    5'-AGACATGGTGAACCAGAGTTTCATCTG-3'   (SEQ ID NO: 675)
                   5'-CCGGACGACGAGACCUUCAUCAAAA-3'     (SEQ ID NO: 1003)
                   3'-UGGGCCUGCUGCUCUGGAAGUAGUUUU-5'   (SEQ ID NO: 349)
MYC-949 Target:    5'-ACCCGGACGACGAGACCTTCATCAAAA-3'   (SEQ ID NO: 676)
                   5'-GAGACCUUCAUCAAAAACAUCAUCA-3'     (SEQ ID NO: 1004)
                   3'-UGCUCUGGAAGUAGUUUUUGUAGUAGU-5'   (SEQ ID NO: 350)
MYC-958 Target:    5'-ACGAGACCTTCATCAAAAACATCATCA-3'   (SEQ ID NO: 677)
                   5'-AAAAACAUCAUCAUCCAGGACUGUA-3'     (SEQ ID NO: 1005)
                   3'-AGUUUUUGUAGUAGUAGGUCCUGACAU-5'   (SEQ ID NO: 351)
MYC-970 Target:    5'-TCAAAAACATCATCATCCAGGACTGTA-3'   (SEQ ID NO: 678)
                   5'-GGACUGUAUGUGGAGCGGCUUCUCG-3'     (SEQ ID NO: 1006)
                   3'-GUCCUGACAUACACCUCGCCGAAGAGC-5'   (SEQ ID NO: 352)
MYC-987 Target:    5'-CAGGACTGTATGTGGAGCGGCTTCTCG-3'   (SEQ ID NO: 679)
                   5'-CUGCUCCACCUCCAGCUUGUACCUG-3'     (SEQ ID NO: 1007)
                   3'-CAGACGAGGUGGAGGUCGAACAUGGAC-5'   (SEQ ID NO: 353)
MYC-1104 Target:   5'-GTCTGCTCCACCTCCAGCTTGTACCTG-3'   (SEQ ID NO: 680)
                   5'-ACCUCCAGCUUGUACCUGCAGGAUC-3'     (SEQ ID NO: 1008)
                   3'-GGUGGAGGUCGAACAUGGACGUCCUAG-5'   (SEQ ID NO: 354)
MYC-1111 Target:   5'-CCACCTCCAGCTTGTACCTGCAGGATC-3'   (SEQ ID NO: 681)
                   5'-CAGCUUGUACCUGCAGGAUCUGAGC-3'     (SEQ ID NO: 1009)
                   3'-AGGUCGAACAUGGACGUCCUAGACUCG-5'   (SEQ ID NO: 355)
MYC-1116 Target:   5'-TCCAGCTTGTACCTGCAGGATCTGAGC-3'   (SEQ ID NO: 682)
                   5'-AAGUCCUGCGCCUCGCAAGACUCCA-3'     (SEQ ID NO: 1010)
                   3'-GGUUCAGGACGCGGAGCGUUCUGAGGU-5'   (SEQ ID NO: 356)
MYC-1210 Target:   5'-CCAAGTCCTGCGCCTCGCAAGACTCCA-3'   (SEQ ID NO: 683)
```

TABLE 3-continued

Selected Human Anti-MYC DsiRNAs, Unmodified Duplexes (Asymmetrics)

```
                     5'-GCAGCGACUCUGAGGAGGAACAAGA-3'    (SEQ ID NO: 1011)
                     3'-GUCGUCGCUGAGACUCCUCCUUGUUCU-5'  (SEQ ID NO: 357)
MYC-1340 Target:     5'-CAGCAGCGACTCTGAGGAGGAACAAGA-3'  (SEQ ID NO: 684)
                     5'-ACUCUGAGGAGGAACAAGAAGAUGA-3'    (SEQ ID NO: 1012)
                     3'-GCUGAGACUCCUCCUUGUUCUUCUACU-5'  (SEQ ID NO: 358)
MYC-1346 Target:     5'-CGACTCTGAGGAGGAACAAGAAGATGA-3'  (SEQ ID NO: 685)
                     5'-GAGGAGGAACAAGAAGAUGAGGAAG-3'    (SEQ ID NO: 1013)
                     3'-GACUCCUCCUUGUUCUUCUACUCCUUC-5'  (SEQ ID NO: 359)
MYC-1351 Target:     5'-CTGAGGAGGAACAAGAAGATGAGGAAG-3'  (SEQ ID NO: 686)
                     5'-AACAAGAAGAUGAGGAAGAAAUCGA-3'    (SEQ ID NO: 1014)
                     3'-CCUUGUUCUUCUACUCCUUCUUUAGCU-5'  (SEQ ID NO: 360)
MYC-1358 Target:     5'-GGAACAAGAAGATGAGGAAGAAATCGA-3'  (SEQ ID NO: 687)
                     5'-AAGAUGAGGAAGAAAUCGAUGUUGU-3'    (SEQ ID NO: 1015)
                     3'-UCUUCUACUCCUUCUUUAGCUACAACA-5'  (SEQ ID NO: 361)
MYC-1364 Target:     5'-AGAAGATGAGGAAGAAATCGATGTTGT-3'  (SEQ ID NO: 688)
                     5'-AGGAAGAAAUCGAUGUUGUUUCUGU-3'    (SEQ ID NO: 1016)
                     3'-ACUCCUUCUUUAGCUACAACAAAGACA-5'  (SEQ ID NO: 362)
MYC-1370 Target:     5'-TGAGGAAGAAATCGATGTTGTTTCTGT-3'  (SEQ ID NO: 689)
                     5'-AAAUCGAUGUUGUUUCUGUGGAAAA-3'    (SEQ ID NO: 1017)
                     3'-UCUUUAGCUACAACAAAGACACCUUUU-5'  (SEQ ID NO: 363)
MYC-1376 Target:     5'-AGAAATCGATGTTGTTTCTGTGGAAAA-3'  (SEQ ID NO: 690)
                     5'-AUGUUGUUUCUGUGGAAAAGAGGCA-3'    (SEQ ID NO: 1018)
                     3'-GCUACAACAAAGACACCUUUUCUCCGU-5'  (SEQ ID NO: 364)
MYC-1382 Target:     5'-CGATGTTGTTTCTGTGGAAAAGAGGCA-3'  (SEQ ID NO: 691)
                     5'-GAGGCAGGCUCCUGGCAAAAGGUCA-3'    (SEQ ID NO: 1019)
                     3'-UUCUCCGUCCGAGGACCGUUUUCCAGU-5'  (SEQ ID NO: 365)
MYC-1401 Target:     5'-AAGAGGCAGGCTCCTGGCAAAAGGTCA-3'  (SEQ ID NO: 692)
                     5'-AGGCUCCUGGCAAAAGGUCAGAGUC-3'    (SEQ ID NO: 1020)
                     3'-CGUCCGAGGACCGUUUUCCAGUCUCAG-5'  (SEQ ID NO: 366)
MYC-1406 Target:     5'-GCAGGCTCCTGGCAAAAGGTCAGAGTC-3'  (SEQ ID NO: 693)
                     5'-CCUGGCAAAAGGUCAGAGUCUGGAU-3'    (SEQ ID NO: 1021)
                     3'-GAGGACCGUUUUCCAGUCUCAGACCUA-5'  (SEQ ID NO: 367)
MYC-1411 Target:     5'-CTCCTGGCAAAAGGTCAGAGTCTGGAT-3'  (SEQ ID NO: 694)
                     5'-CAAAAGGUCAGAGUCUGGAUCACCU-3'    (SEQ ID NO: 1022)
                     3'-CCGUUUUCCAGUCUCAGACCUAGUGGA-5'  (SEQ ID NO: 368)
MYC-1416 Target:     5'-GGCAAAAGGTCAGAGTCTGGATCACCT-3'  (SEQ ID NO: 695)
                     5'-GGUCAGAGUCUGGAUCACCUUCUGC-3'    (SEQ ID NO: 1023)
                     3'-UUCCAGUCUCAGACCUAGUGGAAGACG-5'  (SEQ ID NO: 369)
MYC-1421 Target:     5'-AAGGTCAGAGTCTGGATCACCTTCTGC-3'  (SEQ ID NO: 696)
```

TABLE 3-continued

Selected Human Anti-MYC DsiRNAs, Unmodified Duplexes (Asymmetrics)

```
                5'-GCAAACCUCCUCACAGCCCACUGGU-3'      (SEQ ID NO: 1024)
                3'-GUCGUUUGGAGGAGUGUCGGGUGACCA-5'    (SEQ ID NO: 370)
MYC-1457 Target: 5'-CAGCAAACCTCCTCACAGCCCACTGGT-3'   (SEQ ID NO: 697)
                5'-CCUCACAGCCCACUGGUCCUCAAGA-3'     (SEQ ID NO: 1025)
                3'-GAGGAGUGUCGGGUGACCAGGAGUUCU-5'    (SEQ ID NO: 371)
MYC-1465 Target: 5'-CTCCTCACAGCCCACTGGTCCTCAAGA-3'   (SEQ ID NO: 698)
                5'-CCCUCCACUCGGAAGGACUAUCCUG-3'     (SEQ ID NO: 1026)
                3'-GAGGGAGGUGAGCCUUCCUGAUAGGAC-5'    (SEQ ID NO: 372)
MYC-1531 Target: 5'-CTCCCTCCACTCGGAAGGACTATCCTG-3'   (SEQ ID NO: 699)
                5'-CUCGGAAGGACUAUCCUGCUGCCAA-3'     (SEQ ID NO: 1027)
                3'-GUGAGCCUUCCUGAUAGGACGACGGUU-5'    (SEQ ID NO: 373)
MYC-1538 Target: 5'-CACTCGGAAGGACTATCCTGCTGCCAA-3'   (SEQ ID NO: 700)
                5'-AUCCUGCUGCCAAGAGGGUCAAGUU-3'     (SEQ ID NO: 1028)
                3'-GAUAGGACGACGGUUCUCCCAGUUCAA-5'    (SEQ ID NO: 374)
MYC-1550 Target: 5'-CTATCCTGCTGCCAAGAGGGTCAAGTT-3'   (SEQ ID NO: 701)
                5'-GCUGCCAAGAGGGUCAAGUUGGACA-3'     (SEQ ID NO: 1029)
                3'-GACGACGGUUCUCCCAGUUCAACCUGU-5'    (SEQ ID NO: 375)
MYC-1555 Target: 5'-CTGCTGCCAAGAGGGTCAAGTTGGACA-3'   (SEQ ID NO: 702)
                5'-CAAGAGGGUCAAGUUGGACAGUGUC-3'     (SEQ ID NO: 1030)
                3'-CGGUUCUCCCAGUUCAACCUGUCACAG-5'    (SEQ ID NO: 376)
MYC-1560 Target: 5'-GCCAAGAGGGTCAAGTTGGACAGTGTC-3'   (SEQ ID NO: 703)
                5'-GGGUCAAGUUGGACAGUGUCAGAGU-3'     (SEQ ID NO: 1031)
                3'-CUCCCAGUUCAACCUGUCACAGUCUCA-5'    (SEQ ID NO: 377)
MYC-1565 Target: 5'-GAGGGTCAAGTTGGACAGTGTCAGAGT-3'   (SEQ ID NO: 704)
                5'-AAGUUGGACAGUGUCAGAGUCCUGA-3'     (SEQ ID NO: 1032)
                3'-AGUUCAACCUGUCACAGUCUCAGGACU-5'    (SEQ ID NO: 378)
MYC-1570 Target: 5'-TCAAGTTGGACAGTGTCAGAGTCCTGA-3'   (SEQ ID NO: 705)
                5'-GGACAGUGUCAGAGUCCUGAGACAG-3'     (SEQ ID NO: 1033)
                3'-AACCUGUCACAGUCUCAGGACUCUGUC-5'    (SEQ ID NO: 379)
MYC-1575 Target: 5'-TTGGACAGTGTCAGAGTCCTGAGACAG-3'   (SEQ ID NO: 706)
                5'-CAGAGUCCUGAGACAGAUCAGCAAC-3'     (SEQ ID NO: 1034)
                3'-CAGUCUCAGGACUCUGUCUAGUCGUUG-5'    (SEQ ID NO: 380)
MYC-1584 Target: 5'-GTCAGAGTCCTGAGACAGATCAGCAAC-3'   (SEQ ID NO: 707)
                5'-GAGACAGAUCAGCAACAACCGAAAA-3'     (SEQ ID NO: 1035)
                3'-GACUCUGUCUAGUCGUUGUUGGCUUUU-5'    (SEQ ID NO: 381)
MYC-1593 Target: 5'-CTGAGACAGATCAGCAACAACCGAAAA-3'   (SEQ ID NO: 708)
                5'-GAUCAGCAACAACCGAAAAUGCACC-3'     (SEQ ID NO: 1036)
                3'-GUCUAGUCGUUGUUGGCUUUUACGUGG-5'    (SEQ ID NO: 382)
MYC-1599 Target: 5'-CAGATCAGCAACAACCGAAAATGCACC-3'   (SEQ ID NO: 709)
```

TABLE 3-continued

Selected Human Anti-MYC DsiRNAs, Unmodified Duplexes (Asymmetrics)

```
                    5'-CCUCGGACACCGAGGAGAAUGUCAA-3'      (SEQ ID NO: 1037)
                    3'-CAGGAGCCUGUGGCUCCUCUUACAGUU-5'    (SEQ ID NO: 383)
MYC-1634 Target:    5'-GTCCTCGGACACCGAGGAGAATGTCAA-3'    (SEQ ID NO: 710)
                    5'-GACACCGAGGAGAAUGUCAAGAGGC-3'      (SEQ ID NO: 1038)
                    3'-GCCUGUGGCUCCUCUUACAGUUCUCCG-5'    (SEQ ID NO: 384)
MYC-1639 Target:    5'-CGGACACCGAGGAGAATGTCAAGAGGC-3'    (SEQ ID NO: 711)
                    5'-CAGAGGAGGAACGAGCUAAAACGGA-3'      (SEQ ID NO: 1039)
                    3'-CGGUCUCCUCCUUGCUCGAUUUUGCCU-5'    (SEQ ID NO: 385)
MYC-1687 Target:    5'-GCCAGAGGAGGAACGAGCTAAAACGGA-3'    (SEQ ID NO: 712)
                    5'-AGGAACGAGCUAAAACGGAGCUUUU-3'      (SEQ ID NO: 1040)
                    3'-CCUCCUUGCUCGAUUUUGCCUCGAAAA-5'    (SEQ ID NO: 386)
MYC-1693 Target:    5'-GGAGGAACGAGCTAAAACGGAGCTTTT-3'    (SEQ ID NO: 713)
                    5'-CGAGCUAAAACGGAGCUUUUUUGCC-3'      (SEQ ID NO: 1041)
                    3'-UUGCUCGAUUUUGCCUCGAAAAAACGG-5'    (SEQ ID NO: 387)
MYC-1698 Target:    5'-AACGAGCTAAAACGGAGCTTTTTTGCC-3'    (SEQ ID NO: 714)
                    5'-AAAACGGAGCUUUUUUGCCCUGCGU-3'      (SEQ ID NO: 1042)
                    3'-GAUUUUGCCUCGAAAAAACGGGACGCA-5'    (SEQ ID NO: 388)
MYC-1704 Target:    5'-CTAAAACGGAGCTTTTTTGCCCTGCGT-3'    (SEQ ID NO: 715)
                    5'-GGAGCUUUUUUGCCCUGCGUGACCA-3'      (SEQ ID NO: 1043)
                    3'-UGCCUCGAAAAAACGGGACGCACUGGU-5'    (SEQ ID NO: 389)
MYC-1709 Target:    5'-ACGGAGCTTTTTTGCCCTGCGTGACCA-3'    (SEQ ID NO: 716)
                    5'-GACCAGAUCCCGGAGUUGGAAAACA-3'      (SEQ ID NO: 1044)
                    3'-CACUGGUCUAGGGCCUCAACCUUUUGU-5'    (SEQ ID NO: 390)
MYC-1729 Target:    5'-GTGACCAGATCCCGGAGTTGGAAAACA-3'    (SEQ ID NO: 717)
                    5'-GAUCCCGGAGUUGGAAAACAAUGAA-3'      (SEQ ID NO: 1045)
                    3'-GUCUAGGGCCUCAACCUUUUGUUACUU-5'    (SEQ ID NO: 391)
MYC-1734 Target:    5'-CAGATCCCGGAGTTGGAAAACAATGAA-3'    (SEQ ID NO: 718)
                    5'-CGGAGUUGGAAAACAAUGAAAAGGC-3'      (SEQ ID NO: 1046)
                    3'-GGGCCUCAACCUUUUGUUACUUUUCCG-5'    (SEQ ID NO: 392)
MYC-1739 Target:    5'-CCCGGAGTTGGAAAACAATGAAAAGGC-3'    (SEQ ID NO: 719)
                    5'-AGGUAGUUAUCCUUAAAAAAGCCAC-3'      (SEQ ID NO: 1047)
                    3'-GUUCCAUCAAUAGGAAUUUUUUCGGUG-5'    (SEQ ID NO: 393)
MYC-1769 Target:    5'-CAAGGTAGTTATCCTTAAAAAAGCCAC-3'    (SEQ ID NO: 720)
                    5'-GUUAUCCUUAAAAAAGCCACAGCAU-3'      (SEQ ID NO: 1048)
                    3'-AUCAAUAGGAAUUUUUUCGGUGUCGUA-5'    (SEQ ID NO: 394)
MYC-1774 Target:    5'-TAGTTATCCTTAAAAAAGCCACAGCAT-3'    (SEQ ID NO: 721)
                    5'-CCUUAAAAAAGCCACAGCAUACAUC-3'      (SEQ ID NO: 1049)
                    3'-UAGGAAUUUUUUCGGUGUCGUAUGUAG-5'    (SEQ ID NO: 395)
MYC-1779 Target:    5'-ATCCTTAAAAAAGCCACAGCATACATC-3'    (SEQ ID NO: 722)
```

TABLE 3-continued

Selected Human Anti-MYC DsiRNAs, Unmodified Duplexes (Asymmetrics)

```
                       5'-AAAAAGCCACAGCAUACAUCCUGUC-3'     (SEQ ID NO: 1050)
                       3'-AUUUUUUCGGUGUCGUAUGUAGGACAG-5'   (SEQ ID NO: 396)
MYC-1784 Target:  5'-TAAAAAAGCCACAGCATACATCCTGTC-3'        (SEQ ID NO: 723)
                       5'-GCCACAGCAUACAUCCUGUCCGUCC-3'     (SEQ ID NO: 1051)
                       3'-UUCGGUGUCGUAUGUAGGACAGGCAGG-5'   (SEQ ID NO: 397)
MYC-1789 Target:  5'-AAGCCACAGCATACATCCTGTCCGTCC-3'        (SEQ ID NO: 724)
                       5'-GCAUACAUCCUGUCCGUCCAAGCAG-3'     (SEQ ID NO: 1052)
                       3'-GUCGUAUGUAGGACAGGCAGGUUCGUC-5'   (SEQ ID NO: 398)
MYC-1795 Target:  5'-CAGCATACATCCTGTCCGTCCAAGCAG-3'        (SEQ ID NO: 725)
                       5'-CCUGUCCGUCCAAGCAGAGGAGCAA-3'     (SEQ ID NO: 1053)
                       3'-UAGGACAGGCAGGUUCGUCUCCUCGUU-5'   (SEQ ID NO: 399)
MYC-1803 Target:  5'-ATCCTGTCCGTCCAAGCAGAGGAGCAA-3'        (SEQ ID NO: 726)
                       5'-CCGUCCAAGCAGAGGAGCAAAAGCU-3'     (SEQ ID NO: 1054)
                       3'-CAGGCAGGUUCGUCUCCUCGUUUUCGA-5'   (SEQ ID NO: 400)
MYC-1808 Target:  5'-GTCCGTCCAAGCAGAGGAGCAAAAGCT-3'        (SEQ ID NO: 727)
                       5'-GCAGAGGAGCAAAAGCUCAUUUCUG-3'     (SEQ ID NO: 1055)
                       3'-UUCGUCUCCUCGUUUUCGAGUAAAGAC-5'   (SEQ ID NO: 401)
MYC-1816 Target:  5'-AAGCAGAGGAGCAAAAGCTCATTTCTG-3'        (SEQ ID NO: 728)
                       5'-AGCAAAAGCUCAUUUCUGAAGAGGA-3'     (SEQ ID NO: 1056)
                       3'-CCUCGUUUUCGAGUAAAGACUUCUCCU-5'   (SEQ ID NO: 402)
MYC-1823 Target:  5'-GGAGCAAAAGCTCATTTCTGAAGAGGA-3'        (SEQ ID NO: 729)
                       5'-AAGCUCAUUUCUGAAGAGGACUUGU-3'     (SEQ ID NO: 1057)
                       3'-UUUUCGAGUAAAGACUUCUCCUGAACA-5'   (SEQ ID NO: 403)
MYC-1828 Target:  5'-AAAAGCTCATTTCTGAAGAGGACTTGT-3'        (SEQ ID NO: 730)
                       5'-AUUUCUGAAGAGGACUUGUUGCGGA-3'     (SEQ ID NO: 1058)
                       3'-AGUAAAGACUUCUCCUGAACAACGCCU-5'   (SEQ ID NO: 404)
MYC-1834 Target:  5'-TCATTTCTGAAGAGGACTTGTTGCGGA-3'        (SEQ ID NO: 731)
                       5'-GAAGAGGACUUGUUGCGGAAACGAC-3'     (SEQ ID NO: 1059)
                       3'-GACUUCUCCUGAACAACGCCUUUGCUG-5'   (SEQ ID NO: 405)
MYC-1840 Target:  5'-CTGAAGAGGACTTGTTGCGGAAACGAC-3'        (SEQ ID NO: 732)
                       5'-GGACUUGUUGCGGAAACGACGAGAA-3'     (SEQ ID NO: 1060)
                       3'-CUCCUGAACAACGCCUUUGCUGCUCUU-5'   (SEQ ID NO: 406)
MYC-1845 Target:  5'-GAGGACTTGTTGCGGAAACGACGAGAA-3'        (SEQ ID NO: 733)
                       5'-UGUUGCGGAAACGACGAGAACAGUU-3'     (SEQ ID NO: 1061)
                       3'-GAACAACGCCUUUGCUGCUCUUGUCAA-5'   (SEQ ID NO: 407)
MYC-1850 Target:  5'-CTTGTTGCGGAAACGACGAGAACAGTT-3'        (SEQ ID NO: 734)
                       5'-CGGAAACGACGAGAACAGUUGAAAC-3'     (SEQ ID NO: 1062)
                       3'-ACGCCUUUGCUGCUCUUGUCAACUUUG-5'   (SEQ ID NO: 408)
MYC-1855 Target:  5'-TGCGGAAACGACGAGAACAGTTGAAAC-3'        (SEQ ID NO: 735)
```

TABLE 3-continued

Selected Human Anti-MYC DsiRNAs, Unmodified Duplexes (Asymmetrics)

```
                    5'-AAACUUGAACAGCUACGGAACUCUU-3'      (SEQ ID NO: 1063)
                    3'-UGUUUGAACUUGUCGAUGCCUUGAGAA-5'    (SEQ ID NO: 409)
MYC-1882 Target:    5'-ACAAACTTGAACAGCTACGGAACTCTT-3'    (SEQ ID NO: 736)
                    5'-GAACAGCUACGGAACUCUUGUGCGU-3'      (SEQ ID NO: 1064)
                    3'-AACUUGUCGAUGCCUUGAGAACACGCA-5'    (SEQ ID NO: 410)
MYC-1888 Target:    5'-TTGAACAGCTACGGAACTCTTGTGCGT-3'    (SEQ ID NO: 737)
                    5'-GCUACGGAACUCUUGUGCGUAAGGA-3'      (SEQ ID NO: 1065)
                    3'-GUCGAUGCCUUGAGAACACGCAUUCCU-5'    (SEQ ID NO: 411)
MYC-1893 Target:    5'-CAGCTACGGAACTCTTGTGCGTAAGGA-3'    (SEQ ID NO: 738)
                    5'-AACUCUUGUGCGUAAGGAAAAGUAA-3'      (SEQ ID NO: 1066)
                    3'-CCUUGAGAACACGCAUUCCUUUUCAUU-5'    (SEQ ID NO: 412)
MYC-1900 Target:    5'-GGAACTCTTGTGCGTAAGGAAAAGTAA-3'    (SEQ ID NO: 739)
                    5'-UGUGCGUAAGGAAAAGUAAGGAAAA-3'      (SEQ ID NO: 1067)
                    3'-GAACACGCAUUCCUUUUCAUUCCUUUU-5'    (SEQ ID NO: 413)
MYC-1906 Target:    5'-CTTGTGCGTAAGGAAAAGTAAGGAAAA-3'    (SEQ ID NO: 740)
                    5'-GUAAGGAAAAGUAAGGAAAACGAUU-3'      (SEQ ID NO: 1068)
                    3'-CGCAUUCCUUUUCAUUCCUUUUGCUAA-5'    (SEQ ID NO: 414)
MYC-1911 Target:    5'-GCGTAAGGAAAAGTAAGGAAAACGATT-3'    (SEQ ID NO: 741)
                    5'-GUAAGGAAAACGAUUCCUUCUAACA-3'      (SEQ ID NO: 1069)
                    3'-UUCAUUCCUUUUGCUAAGGAAGAUUGU-5'    (SEQ ID NO: 415)
MYC-1921 Target:    5'-AAGTAAGGAAAACGATTCCTTCTAACA-3'    (SEQ ID NO: 742)
                    5'-GAAAACGAUUCCUUCUAACAGAAAU-3'      (SEQ ID NO: 1070)
                    3'-UCCUUUUGCUAAGGAAGAUUGUCUUUA-5'    (SEQ ID NO: 416)
MYC-1926 Target:    5'-AGGAAAACGATTCCTTCTAACAGAAAT-3'    (SEQ ID NO: 743)
                    5'-CGAUUCCUUCUAACAGAAAUGUCCU-3'      (SEQ ID NO: 1071)
                    3'-UUGCUAAGGAAGAUUGUCUUUACAGGA-5'    (SEQ ID NO: 417)
MYC-1931 Target:    5'-AACGATTCCTTCTAACAGAAATGTCCT-3'    (SEQ ID NO: 744)
                    5'-CUUCUAACAGAAAUGUCCUGAGCAA-3'      (SEQ ID NO: 1072)
                    3'-AGGAAGAUUGUCUUUACAGGACUCGUU-5'    (SEQ ID NO: 418)
MYC-1937 Target:    5'-TCCTTCTAACAGAAATGTCCTGAGCAA-3'    (SEQ ID NO: 745)
                    5'-CAGAAAUGUCCUGAGCAAUCACCUA-3'      (SEQ ID NO: 1073)
                    3'-UUGUCUUUACAGGACUCGUUAGUGGAU-5'    (SEQ ID NO: 419)
MYC-1944 Target:    5'-AACAGAAATGTCCTGAGCAATCACCTA-3'    (SEQ ID NO: 746)
                    5'-CCUGAGCAAUCACCUAUGAACUUGU-3'      (SEQ ID NO: 1074)
                    3'-CAGGACUCGUUAGUGGAUACUUGAACA-5'    (SEQ ID NO: 420)
MYC-1953 Target:    5'-GTCCTGAGCAATCACCTATGAACTTGT-3'    (SEQ ID NO: 747)
                    5'-CAAUCACCUAUGAACUUGUUUCAAA-3'      (SEQ ID NO: 1075)
                    3'-UCGUUAGUGGAUACUUGAACAAAGUUU-5'    (SEQ ID NO: 421)
MYC-1959 Target:    5'-AGCAATCACCTATGAACTTGTTTCAAA-3'    (SEQ ID NO: 748)
```

TABLE 3-continued

Selected Human Anti-MYC DsiRNAs, Unmodified Duplexes (Asymmetrics)

```
                     5'-CCUAUGAACUUGUUUCAAAUGCAUG-3'    (SEQ ID NO: 1076)
                     3'-GUGGAUACUUGAACAAAGUUUACGUAC-5'  (SEQ ID NO: 422)
MYC-1965 Target:     5'-CACCTATGAACTTGTTTCAAATGCATG-3'  (SEQ ID NO: 749)
                     5'-GAACUUGUUUCAAAUGCAUGAUCAA-3'    (SEQ ID NO: 1077)
                     3'-UACUUGAACAAAGUUUACGUACUAGUU-5'  (SEQ ID NO: 423)
MYC-1970 Target:     5'-ATGAACTTGTTTCAAATGCATGATCAA-3'  (SEQ ID NO: 750)
                     5'-GUUUCAAAUGCAUGAUCAAAUGCAA-3'    (SEQ ID NO: 1078)
                     3'-AACAAAGUUUACGUACUAGUUUACGUU-5'  (SEQ ID NO: 424)
MYC-1976 Target:     5'-TTGTTTCAAATGCATGATCAAATGCAA-3'  (SEQ ID NO: 751)
                     5'-AAAUGCAUGAUCAAAUGCAACCUCA-3'    (SEQ ID NO: 1079)
                     3'-AGUUUACGUACUAGUUUACGUUGGAGU-5'  (SEQ ID NO: 425)
MYC-1981 Target:     5'-TCAAATGCATGATCAAATGCAACCTCA-3'  (SEQ ID NO: 752)
                     5'-GAUCAAAUGCAACCUCACAACCUUG-3'    (SEQ ID NO: 1080)
                     3'-UACUAGUUUACGUUGGAGUGUUGGAAC-5'  (SEQ ID NO: 426)
MYC-1989 Target:     5'-ATGATCAAATGCAACCTCACAACCTTG-3'  (SEQ ID NO: 753)
                     5'-AAUGCAACCUCACAACCUUGGCUGA-3'    (SEQ ID NO: 1081)
                     3'-GUUUACGUUGGAGUGUUGGAACCGACU-5'  (SEQ ID NO: 427)
MYC-1994 Target:     5'-CAAATGCAACCTCACAACCTTGGCTGA-3'  (SEQ ID NO: 754)
                     5'-CCUCACAACCUUGGCUGAGUCUUGA-3'    (SEQ ID NO: 1082)
                     3'-UUGGAGUGUUGGAACCGACUCAGAACU-5'  (SEQ ID NO: 428)
MYC-2001 Target:     5'-AACCTCACAACCTTGGCTGAGTCTTGA-3'  (SEQ ID NO: 755)
                     5'-CAACCUUGGCUGAGUCUUGAGACUG-3'    (SEQ ID NO: 1083)
                     3'-GUGUUGGAACCGACUCAGAACUCUGAC-5'  (SEQ ID NO: 429)
MYC-2006 Target:     5'-CACAACCTTGGCTGAGTCTTGAGACTG-3'  (SEQ ID NO: 756)
                     5'-GGCUGAGUCUUGAGACUGAAAGAUU-3'    (SEQ ID NO: 1084)
                     3'-AACCGACUCAGAACUCUGACUUUCUAA-5'  (SEQ ID NO: 430)
MYC-2013 Target:     5'-TTGGCTGAGTCTTGAGACTGAAAGATT-3'  (SEQ ID NO: 757)
                     5'-GUCUUGAGACUGAAAGAUUUAGCCA-3'    (SEQ ID NO: 1085)
                     3'-CUCAGAACUCUGACUUUCUAAAUCGGU-5'  (SEQ ID NO: 431)
MYC-2019 Target:     5'-GAGTCTTGAGACTGAAAGATTTAGCCA-3'  (SEQ ID NO: 758)
                     5'-GACUGAAAGAUUUAGCCAUAAUGUA-3'    (SEQ ID NO: 1086)
                     3'-CUCUGACUUUCUAAAUCGGUAUUACAU-5'  (SEQ ID NO: 432)
MYC-2026 Target:     5'-GAGACTGAAAGATTTAGCCATAATGTA-3'  (SEQ ID NO: 759)
                     5'-AAAGAUUUAGCCAUAAUGUAAACUG-3'    (SEQ ID NO: 1087)
                     3'-ACUUUCUAAAUCGGUAUUACAUUUGAC-5'  (SEQ ID NO: 433)
MYC-2031 Target:     5'-TGAAAGATTTAGCCATAATGTAAACTG-3'  (SEQ ID NO: 760)
                     5'-GCCAUAAUGUAAACUGCCUCAAAUU-3'    (SEQ ID NO: 1088)
                     3'-AUCGGUAUUACAUUUGACGGAGUUUAA-5'  (SEQ ID NO: 434)
MYC-2040 Target:     5'-TAGCCATAATGTAAACTGCCTCAAATT-3'  (SEQ ID NO: 761)
```

TABLE 3-continued

Selected Human Anti-MYC DsiRNAs, Unmodified Duplexes (Asymmetrics)

```
                    5'-GUAAACUGCCUCAAAUUGGACUUUG-3'      (SEQ ID NO: 1089)
                    3'-UACAUUUGACGGAGUUUAACCUGAAAC-5'    (SEQ ID NO: 435)

MYC-2048 Target:    5'-ATGTAAACTGCCTCAAATTGGACTTTG-3'    (SEQ ID NO: 762)
                    5'-UGCCUCAAAUUGGACUUUGGGCAUA-3'      (SEQ ID NO: 1090)
                    3'-UGACGGAGUUUAACCUGAAACCCGUAU-5'    (SEQ ID NO: 436)

MYC-2054 Target:    5'-ACTGCCTCAAATTGGACTTTGGGCATA-3'    (SEQ ID NO: 763)
                    5'-CAAAUUGGACUUUGGGCAUAAAAGA-3'      (SEQ ID NO: 1091)
                    3'-GAGUUUAACCUGAAACCCGUAUUUUCU-5'    (SEQ ID NO: 437)

MYC-2059 Target:    5'-CTCAAATTGGACTTTGGGCATAAAAGA-3'    (SEQ ID NO: 764)
                    5'-GACUUUGGGCAUAAAAGAACUUUUU-3'      (SEQ ID NO: 1092)
                    3'-ACCUGAAACCCGUAUUUUCUUGAAAAA-5'    (SEQ ID NO: 438)

MYC-2066 Target:    5'-TGGACTTTGGGCATAAAAGAACTTTTT-3'    (SEQ ID NO: 765)
                    5'-GGCAUAAAAGAACUUUUUAUGCUU-3'       (SEQ ID NO: 1093)
                    3'-ACCCGUAUUUUCUUGAAAAAAUACGAA-5'    (SEQ ID NO: 439)

MYC-2073 Target:    5'-TGGGCATAAAAGAACTTTTTTATGCTT-3'    (SEQ ID NO: 766)
                    5'-AAAAGAACUUUUUUAUGCUUACCAU-3'      (SEQ ID NO: 1094)
                    3'-UAUUUUCUUGAAAAAAUACGAAUGGUA-5'    (SEQ ID NO: 440)

MYC-2078 Target:    5'-ATAAAAGAACTTTTTTATGCTTACCAT-3'    (SEQ ID NO: 767)
                    5'-AACUUUUUUAUGCUUACCAUCUUUU-3'      (SEQ ID NO: 1095)
                    3'-UCUUGAAAAAAUACGAAUGGUAGAAAA-5'    (SEQ ID NO: 441)

MYC-2083 Target:    5'-AGAACTTTTTTATGCTTACCATCTTTT-3'    (SEQ ID NO: 768)
                    5'-UUUAUGCUUACCAUCUUUUUUUUUU-3'      (SEQ ID NO: 1096)
                    3'-AAAAAUACGAAUGGUAGAAAAAAAAAA-5'    (SEQ ID NO: 442)

MYC-2089 Target:    5'-TTTTTATGCTTACCATCTTTTTTTTT-3'     (SEQ ID NO: 769)
                    5'-GCUUACCAUCUUUUUUUUUUCUUUA-3'      (SEQ ID NO: 1097)
                    3'-UACGAAUGGUAGAAAAAAAAAAGAAAU-5'    (SEQ ID NO: 443)

MYC-2094 Target:    5'-ATGCTTACCATCTTTTTTTTTCTTTA-3'     (SEQ ID NO: 770)
                    5'-CCAUCUUUUUUUUUUCUUUAACAGA-3'      (SEQ ID NO: 1098)
                    3'-AUGGUAGAAAAAAAAAAGAAAUUGUCU-5'    (SEQ ID NO: 444)

MYC-2099 Target:    5'-TACCATCTTTTTTTTTCTTTAACAGA-3'     (SEQ ID NO: 771)
                    5'-UUUUUUUUUCUUUAACAGAUUUGUA-3'      (SEQ ID NO: 1099)
                    3'-GAAAAAAAAAGAAAUUGUCUAAACAU-5'     (SEQ ID NO: 445)

MYC-2105 Target:    5'-CTTTTTTTTTCTTTAACAGATTTGTA-3'     (SEQ ID NO: 772)
                    5'-CUUUAACAGAUUUGUAUUUAAGAAU-3'      (SEQ ID NO: 1100)
                    3'-AAGAAAUUGUCUAAACAUAAAUUCUUA-5'    (SEQ ID NO: 446)

MYC-2114 Target:    5'-TTCTTTAACAGATTTGTATTTAAGAAT-3'    (SEQ ID NO: 773)
                    5'-CAGAUUUGUAUUUAAGAAUUGUUUU-3'      (SEQ ID NO: 1101)
                    3'-UUGUCUAAACAUAAAUUCUUAACAAAA-5'    (SEQ ID NO: 447)

MYC-2120 Target:    5'-AACAGATTTGTATTTAAGAATTGTTTT-3'    (SEQ ID NO: 774)
```

TABLE 3-continued

Selected Human Anti-MYC DsiRNAs, Unmodified Duplexes (Asymmetrics)

```
                        5'-UAUUUAAGAAUUGUUUUUAAAAAAU-3'   (SEQ ID NO: 1102)
                        3'-ACAUAAAUUCUUAACAAAAAUUUUUUA-5' (SEQ ID NO: 448)
MYC-2128 Target: 5'-TGTATTTAAGAATTGTTTTTAAAAAAT-3'        (SEQ ID NO: 775)
                        5'-GAAUUGUUUUUAAAAAAUUUUAAGA-3'   (SEQ ID NO: 1103)
                        3'-UUCUUAACAAAAAUUUUUAAAAUUCU-5'  (SEQ ID NO: 449)
MYC-2135 Target: 5'-AAGAATTGTTTTTAAAAAATTTTAAGA-3'        (SEQ ID NO: 776)
                        5'-AAUGUUUCUCUGUAAAUAUUGCCAU-3'   (SEQ ID NO: 1104)
                        3'-UGUUACAAAGAGACAUUUAUAACGGUA-5' (SEQ ID NO: 450)
MYC-2167 Target: 5'-ACAATGTTTCTCTGTAAATATTGCCAT-3'        (SEQ ID NO: 777)
                        5'-CUGUAAAUAUUGCCAUUAAAUGUAA-3'   (SEQ ID NO: 1105)
                        3'-GAGACAUUUAUAACGGUAAUUUACAUU-5' (SEQ ID NO: 451)
MYC-2176 Target: 5'-CTCTGTAAATATTGCCATTAAATGTAA-3'        (SEQ ID NO: 778)
                        5'-AAUAUUGCCAUUAAAUGUAAAUAAC-3'   (SEQ ID NO: 1106)
                        3'-AUUUAUAACGGUAAUUUACAUUUAUUG-5' (SEQ ID NO: 452)
MYC-2181 Target: 5'-TAAATATTGCCATTAAATGTAAATAAC-3'        (SEQ ID NO: 779)
                        5'-CCAUUAAAUGUAAAUAACUUUAAUA-3'   (SEQ ID NO: 1107)
                        3'-ACGGUAAUUUACAUUUAUUGAAAUUAU-5' (SEQ ID NO: 453)
MYC-2188 Target: 5'-TGCCATTAAATGTAAATAACTTTAATA-3'        (SEQ ID NO: 780)
                        5'-UUAAUAAAACGUUUAUAGCAGUUAC-3'   (SEQ ID NO: 1108)
                        3'-GAAAUUAUUUGCAAAUAUCGUCAAUG-5'  (SEQ ID NO: 454)
MYC-2207 Target: 5'-CTTTAATAAAACGTTTATAGCAGTTAC-3'        (SEQ ID NO: 781)
                        5'-CAGAAUUUCAAUCCUAGUAUAUAGU-3'   (SEQ ID NO: 1109)
                        3'-GUGUCUUAAAGUUAGGAUCAUAUAUCA-5' (SEQ ID NO: 455)
MYC-2233 Target: 5'-CACAGAATTTCAATCCTAGTATATAGT-3'        (SEQ ID NO: 782)
                        5'-CUAGUAUUAUAGGUACUAUAAACCC-3'   (SEQ ID NO: 1110)
                        3'-UGGAUCAUAAUAUCCAUGAUAUUUGGG-5' (SEQ ID NO: 456)
MYC-2260 Target: 5'-ACCTAGTATTATAGGTACTATAAACCC-3'        (SEQ ID NO: 783)
                        5'-UAUAGGUACUAUAAACCCUAAUUUU-3'   (SEQ ID NO: 1111)
                        3'-UAAUAUCCAUGAUAUUUGGGAUUAAAA-5' (SEQ ID NO: 457)
MYC-2267 Target: 5'-ATTATAGGTACTATAAACCCTAATTTT-3'        (SEQ ID NO: 784)
                        5'-ACUAUAAACCCUAAUUUUUUUAUU-3'    (SEQ ID NO: 1112)
                        3'-CAUGAUAUUUGGGAUUAAAAAAAUAA-5'  (SEQ ID NO: 458)
MYC-2274 Target: 5'-GTACTATAAACCCTAATTTTTTTATT-3'         (SEQ ID NO: 785)
                        5'-CCCUAAUUUUUUUAUUUAAGUACA-3'    (SEQ ID NO: 1113)
                        3'-UUGGGAUUAAAAAAAUAAAUUCAUGU-5'  (SEQ ID NO: 459)
MYC-2282 Target: 5'-AACCCTAATTTTTTTATTTAAGTACA-3'         (SEQ ID NO: 786)
                        5'-AUUUUUUUUAUUUAAGUACAUUUUG-3'   (SEQ ID NO: 1114)
                        3'-AUUAAAAAAAUAAAUUCAUGUAAAAC-5'  (SEQ ID NO: 460)
MYC-2287 Target: 5'-TAATTTTTTTTATTTAAGTACATTTTG-3'        (SEQ ID NO: 787)
```

TABLE 3-continued

Selected Human Anti-MYC DsiRNAs, Unmodified Duplexes (Asymmetrics)

```
                5'-UAUUUAAGUACAUUUGCUUUUUAA-3'     (SEQ ID NO: 1115)
                3'-AAAUAAAUUCAUGUAAAACGAAAAAUU-5'  (SEQ ID NO: 461)
MYC-2295 Target: 5'-TTTATTTAAGTACATTTGCTTTTTAA-3'   (SEQ ID NO: 788)
                5'-AAGUACAUUUGCUUUUUAAAGUUG-3'     (SEQ ID NO: 1116)
                3'-AAUUCAUGUAAACGAAAAAUUUCAAC-5'   (SEQ ID NO: 462)
MYC-2300 Target: 5'-TTAAGTACATTTGCTTTTTAAAGTTG-3'   (SEQ ID NO: 789)
                5'-AUUUUGCUUUUUAAAGUUGAUUUUU-3'    (SEQ ID NO: 1117)
                3'-UGUAAAACGAAAAAUUUCAACUAAAAA-5'  (SEQ ID NO: 463)
MYC-2306 Target: 5'-ACATTTGCTTTTTAAAGTTGATTTTT-3'   (SEQ ID NO: 790)
                5'-CUUUUUAAAGUUGAUUUUUUUCUAU-3'    (SEQ ID NO: 1118)
                3'-ACGAAAAAUUUCAACUAAAAAAGAUA-5'   (SEQ ID NO: 464)
MYC-2312 Target: 5'-TGCTTTTTAAAGTTGATTTTTTTCTAT-3'  (SEQ ID NO: 791)
                5'-UAUUGUUUUUAGAAAAAAUAAAAUA-3'    (SEQ ID NO: 1119)
                3'-AGAUAACAAAAAUCUUUUUUAUUUUAU-5'  (SEQ ID NO: 465)
MYC-2334 Target: 5'-TCTATTGTTTTTAGAAAAAATAAAATA-3'  (SEQ ID NO: 792)
                5'-UUUUUAGAAAAAAUAAAAUAACUGG-3'    (SEQ ID NO: 1120)
                3'-ACAAAAAUCUUUUUUAUUUUAUUGACC-5'  (SEQ ID NO: 466)
MYC-2339 Target: 5'-TGTTTTTAGAAAAAATAAAATAACTGG-3'  (SEQ ID NO: 793)
                5'-AAAAAUAAAAUAACUGGCAAAUAUA-3'    (SEQ ID NO: 1121)
                3'-CUUUUUUAUUUUAUUGACCGUUUAUAU-5'  (SEQ ID NO: 467)
MYC-2347 Target: 5'-GAAAAAATAAAATAACTGGCAAATATA-3'  (SEQ ID NO: 794)
                5'-AAUAACUGGCAAAUAUAUCAUUGAG-3'    (SEQ ID NO: 1122)
                3'-UUUUAUUGACCGUUUAUAUAGUAACUC-5'  (SEQ ID NO: 468)
MYC-2355 Target: 5'-AAAATAACTGGCAAATATATCATTGAG-3'  (SEQ ID NO: 795)
                5'-CAAAUAUAUCAUUGAGCCAAAUCUU-3'    (SEQ ID NO: 1123)
                3'-CCGUUUAUAUAGUAACUCGGUUUAGAA-5'  (SEQ ID NO: 469)
MYC-2364 Target: 5'-GGCAAATATATCATTGAGCCAAATCTT-3'  (SEQ ID NO: 796)
                5'-AUCAUUGAGCCAAAUCUUAAAAAAA-3'    (SEQ ID NO: 1124)
                3'-UAUAGUAACUCGGUUUAGAAUUUUUUU-5'  (SEQ ID NO: 470)
MYC-2371 Target: 5'-ATATCATTGAGCCAAATCTTAAAAAAA-3'  (SEQ ID NO: 797)
                5'-GAGCCAAAUCUUAAAAAAAAAAAA-3'     (SEQ ID NO: 1125)
                3'-AACUCGGUUUAGAAUUUUUUUUUUUU-5'   (SEQ ID NO: 471)
MYC-2377 Target: 5'-TTGAGCCAAATCTTAAAAAAAAAAAA-3'   (SEQ ID NO: 798)
                5'-ACUCGCUGUAGUAAUUCCAGCGAGA-3'    (SEQ ID NO: 1126)
                3'-AUUGAGCGACAUCAUUAAGGUCGCUCU-5'  (SEQ ID NO: 472)
MYC-188 Target:  5'-TAACTCGCTGTAGTAATTCCAGCGAGA-3'  (SEQ ID NO: 799)
                5'-CUCGCUGUAGUAAUUCCAGCGAGAG-3'    (SEQ ID NO: 1127)
                3'-UUGAGCGACAUCAUUAAGGUCGCUCUC-5'  (SEQ ID NO: 473)
MYC-189 Target:  5'-AACTCGCTGTAGTAATTCCAGCGAGAG-3'  (SEQ ID NO: 800)
```

TABLE 3-continued

Selected Human Anti-MYC DsiRNAs, Unmodified Duplexes (Asymmetrics)

|  |  |  |  |
|---|---|---|---|
|  | 5'-UCGCUGUAGUAAUUCCAGCGAGAGG-3' | (SEQ ID NO: 1128) |
|  | 3'-UGAGCGACAUCAUUAAGGUCGCUCUCC-5' | (SEQ ID NO: 474) |
| MYC-190 Target: | 5'-ACTCGCTGTAGTAATTCCAGCGAGAGG-3' | (SEQ ID NO: 801) |
|  | 5'-CGCUGUAGUAAUUCCAGCGAGAGGC-3' | (SEQ ID NO: 1129) |
|  | 3'-GAGCGACAUCAUUAAGGUCGCUCUCCG-5' | (SEQ ID NO: 475) |
| MYC-191 Target: | 5'-CTCGCTGTAGTAATTCCAGCGAGAGGC-3' | (SEQ ID NO: 802) |
|  | 5'-GCUGUAGUAAUUCCAGCGAGAGGCA-3' | (SEQ ID NO: 1130) |
|  | 3'-AGCGACAUCAUUAAGGUCGCUCUCCGU-5' | (SEQ ID NO: 476) |
| MYC-192 Target: | 5'-TCGCTGTAGTAATTCCAGCGAGAGGCA-3' | (SEQ ID NO: 803) |
|  | 5'-CUGUAGUAAUUCCAGCGAGAGGCAG-3' | (SEQ ID NO: 1131) |
|  | 3'-GCGACAUCAUUAAGGUCGCUCUCCGUC-5' | (SEQ ID NO: 477) |
| MYC-193 Target: | 5'-CGCTGTAGTAATTCCAGCGAGAGGCAG-3' | (SEQ ID NO: 804) |
|  | 5'-UGUAGUAAUUCCAGCGAGAGGCAGA-3' | (SEQ ID NO: 1132) |
|  | 3'-CGACAUCAUUAAGGUCGCUCUCCGUCU-5' | (SEQ ID NO: 478) |
| MYC-194 Target: | 5'-GCTGTAGTAATTCCAGCGAGAGGCAGA-3' | (SEQ ID NO: 805) |
|  | 5'-GUAGUAAUUCCAGCGAGAGGCAGAG-3' | (SEQ ID NO: 1133) |
|  | 3'-GACAUCAUUAAGGUCGCUCUCCGUCUC-5' | (SEQ ID NO: 479) |
| MYC-195 Target: | 5'-CTGTAGTAATTCCAGCGAGAGGCAGAG-3' | (SEQ ID NO: 806) |
|  | 5'-CUUCACCAACAGGAACUAUGACCUC-3' | (SEQ ID NO: 1134) |
|  | 3'-UCGAAGUGGUUGUCCUUGAUACUGGAG-5' | (SEQ ID NO: 480) |
| MYC-612 Target: | 5'-AGCTTCACCAACAGGAACTATGACCTC-3' | (SEQ ID NO: 807) |
|  | 5'-UUCACCAACAGGAACUAUGACCUCG-3' | (SEQ ID NO: 1135) |
|  | 3'-CGAAGUGGUUGUCCUUGAUACUGGAGC-5' | (SEQ ID NO: 481) |
| MYC-613 Target: | 5'-GCTTCACCAACAGGAACTATGACCTCG-3' | (SEQ ID NO: 808) |
|  | 5'-UCACCAACAGGAACUAUGACCUCGA-3' | (SEQ ID NO: 1136) |
|  | 3'-GAAGUGGUUGUCCUUGAUACUGGAGCU-5' | (SEQ ID NO: 482) |
| MYC-614 Target: | 5'-CTTCACCAACAGGAACTATGACCTCGA-3' | (SEQ ID NO: 809) |
|  | 5'-CACCAACAGGAACUAUGACCUCGAC-3' | (SEQ ID NO: 1137) |
|  | 3'-AAGUGGUUGUCCUUGAUACUGGAGCUG-5' | (SEQ ID NO: 483) |
| MYC-615 Target: | 5'-TTCACCAACAGGAACTATGACCTCGAC-3' | (SEQ ID NO: 810) |
|  | 5'-ACCAACAGGAACUAUGACCUCGACU-3' | (SEQ ID NO: 1138) |
|  | 3'-AGUGGUUGUCCUUGAUACUGGAGCUGA-5' | (SEQ ID NO: 484) |
| MYC-616 Target: | 5'-TCACCAACAGGAACTATGACCTCGACT-3' | (SEQ ID NO: 811) |
|  | 5'-CCAACAGGAACUAUGACCUCGACUA-3' | (SEQ ID NO: 1139) |
|  | 3'-GUGGUUGUCCUUGAUACUGGAGCUGAU-5' | (SEQ ID NO: 485) |
| MYC-617 Target: | 5'-CACCAACAGGAACTATGACCTCGACTA-3' | (SEQ ID NO: 812) |
|  | 5'-CAACAGGAACUAUGACCUCGACUAC-3' | (SEQ ID NO: 1140) |
|  | 3'-UGGUUGUCCUUGAUACUGGAGCUGAUG-5' | (SEQ ID NO: 486) |
| MYC-618 Target: | 5'-ACCAACAGGAACTATGACCTCGACTAC-3' | (SEQ ID NO: 813) |

TABLE 3-continued

Selected Human Anti-MYC DsiRNAs, Unmodified Duplexes (Asymmetrics)

```
                   5'-AACAGGAACUAUGACCUCGACUACG-3'      (SEQ ID NO: 1141)
                   3'-GGUUGUCCUUGAUACUGGAGCUGAUGC-5'    (SEQ ID NO: 487)

MYC-619 Target:    5'-CCAACAGGAACTATGACCTCGACTACG-3'    (SEQ ID NO: 814)
                   5'-ACAGGAACUAUGACCUCGACUACGA-3'      (SEQ ID NO: 1142)
                   3'-GUUGUCCUUGAUACUGGAGCUGAUGCU-5'    (SEQ ID NO: 488)

MYC-620 Target:    5'-CAACAGGAACTATGACCTCGACTACGA-3'    (SEQ ID NO: 815)
                   5'-CAGGAACUAUGACCUCGACUACGAC-3'      (SEQ ID NO: 1143)
                   3'-UUGUCCUUGAUACUGGAGCUGAUGCUG-5'    (SEQ ID NO: 489)

MYC-621 Target:    5'-AACAGGAACTATGACCTCGACTACGAC-3'    (SEQ ID NO: 816)
                   5'-AGGAACUAUGACCUCGACUACGACU-3'      (SEQ ID NO: 1144)
                   3'-UGUCCUUGAUACUGGAGCUGAUGCUGA-5'    (SEQ ID NO: 490)

MYC-622 Target:    5'-ACAGGAACTATGACCTCGACTACGACT-3'    (SEQ ID NO: 817)
                   5'-GGAACUAUGACCUCGACUACGACUC-3'      (SEQ ID NO: 1145)
                   3'-GUCCUUGAUACUGGAGCUGAUGCUGAG-5'    (SEQ ID NO: 491)

MYC-623 Target:    5'-CAGGAACTATGACCTCGACTACGACTC-3'    (SEQ ID NO: 818)
                   5'-GAACUAUGACCUCGACUACGACUCG-3'      (SEQ ID NO: 1146)
                   3'-UCCUUGAUACUGGAGCUGAUGCUGAGC-5'    (SEQ ID NO: 492)

MYC-624 Target:    5'-AGGAACTATGACCTCGACTACGACTCG-3'    (SEQ ID NO: 819)
                   5'-AACUAUGACCUCGACUACGACUCGG-3'      (SEQ ID NO: 1147)
                   3'-CCUUGAUACUGGAGCUGAUGCUGAGCC-5'    (SEQ ID NO: 493)

MYC-625 Target:    5'-GGAACTATGACCTCGACTACGACTCGG-3'    (SEQ ID NO: 820)
                   5'-ACUAUGACCUCGACUACGACUCGGU-3'      (SEQ ID NO: 1148)
                   3'-CUUGAUACUGGAGCUGAUGCUGAGCCA-5'    (SEQ ID NO: 494)

MYC-626 Target:    5'-GAACTATGACCTCGACTACGACTCGGT-3'    (SEQ ID NO: 821)
                   5'-CUAUGACCUCGACUACGACUCGGUG-3'      (SEQ ID NO: 1149)
                   3'-UUGAUACUGGAGCUGAUGCUGAGCCAC-5'    (SEQ ID NO: 495)

MYC-627 Target:    5'-AACTATGACCTCGACTACGACTCGGTG-3'    (SEQ ID NO: 822)
                   5'-UAUGACCUCGACUACGACUCGGUGC-3'      (SEQ ID NO: 1150)
                   3'-UGAUACUGGAGCUGAUGCUGAGCCACG-5'    (SEQ ID NO: 496)

MYC-628 Target:    5'-ACTATGACCTCGACTACGACTCGGTGC-3'    (SEQ ID NO: 823)
                   5'-AUGACCUCGACUACGACUCGGUGCA-3'      (SEQ ID NO: 1151)
                   3'-GAUACUGGAGCUGAUGCUGAGCCACGU-5'    (SEQ ID NO: 497)

MYC-629 Target:    5'-CTATGACCTCGACTACGACTCGGTGCA-3'    (SEQ ID NO: 824)
                   5'-GAGGAUAUCUGGAAGAAAUUCGAGC-3'      (SEQ ID NO: 1152)
                   3'-CGCUCCUAUAGACCUUCUUUAAGCUCG-5'    (SEQ ID NO: 498)

MYC-733 Target:    5'-GCGAGGATATCTGGAAGAAATTCGAGC-3'    (SEQ ID NO: 825)
                   5'-AGGAUAUCUGGAAGAAAUUCGAGCU-3'      (SEQ ID NO: 1153)
                   3'-GCUCCUAUAGACCUUCUUUAAGCUCGA-5'    (SEQ ID NO: 499)

MYC-734 Target:    5'-CGAGGATATCTGGAAGAAATTCGAGCT-3'    (SEQ ID NO: 826)
```

TABLE 3-continued

Selected Human Anti-MYC DsiRNAs, Unmodified Duplexes (Asymmetrics)

|  |  |  |  |
|---|---|---|---|
|  | 5'-GGAUAUCUGGAAGAAAUUCGAGCUG-3' | (SEQ ID NO: 1154) |  |
|  | 3'-CUCCUAUAGACCUUCUUUAAGCUCGAC-5' | (SEQ ID NO: 500) |  |
| MYC-735 Target: | 5'-GAGGATATCTGGAAGAAATTCGAGCTG-3' | (SEQ ID NO: 827) |  |
|  | 5'-GAUAUCUGGAAGAAAUUCGAGCUGC-3' | (SEQ ID NO: 1155) |  |
|  | 3'-UCCUAUAGACCUUCUUUAAGCUCGACG-5' | (SEQ ID NO: 501) |  |
| MYC-736 Target: | 5'-AGGATATCTGGAAGAAATTCGAGCTGC-3' | (SEQ ID NO: 828) |  |
|  | 5'-AUAUCUGGAAGAAAUUCGAGCUGCU-3' | (SEQ ID NO: 1156) |  |
|  | 3'-CCUAUAGACCUUCUUUAAGCUCGACGA-5' | (SEQ ID NO: 502) |  |
| MYC-737 Target: | 5'-GGATATCTGGAAGAAATTCGAGCTGCT-3' | (SEQ ID NO: 829) |  |
|  | 5'-UAUCUGGAAGAAAUUCGAGCUGCUG-3' | (SEQ ID NO: 1157) |  |
|  | 3'-CUAUAGACCUUCUUUAAGCUCGACGAC-5' | (SEQ ID NO: 503) |  |
| MYC-738 Target: | 5'-GATATCTGGAAGAAATTCGAGCTGCTG-3' | (SEQ ID NO: 830) |  |
|  | 5'-AUCUGGAAGAAAUUCGAGCUGCUGC-3' | (SEQ ID NO: 1158) |  |
|  | 3'-UAUAGACCUUCUUUAAGCUCGACGACG-5' | (SEQ ID NO: 504) |  |
| MYC-739 Target: | 5'-ATATCTGGAAGAAATTCGAGCTGCTGC-3' | (SEQ ID NO: 831) |  |
|  | 5'-UCUGGAAGAAAUUCGAGCUGCUGCC-3' | (SEQ ID NO: 1159) |  |
|  | 3'-AUAGACCUUCUUUAAGCUCGACGACGG-5' | (SEQ ID NO: 505) |  |
| MYC-740 Target: | 5'-TATCTGGAAGAAATTCGAGCTGCTGCC-3' | (SEQ ID NO: 832) |  |
|  | 5'-CUGGAAGAAAUUCGAGCUGCUGCCC-3' | (SEQ ID NO: 1160) |  |
|  | 3'-UAGACCUUCUUUAAGCUCGACGACGGG-5' | (SEQ ID NO: 506) |  |
| MYC-741 Target: | 5'-ATCTGGAAGAAATTCGAGCTGCTGCCC-3' | (SEQ ID NO: 833) |  |
|  | 5'-UGGAAGAAAUUCGAGCUGCUGCCCA-3' | (SEQ ID NO: 1161) |  |
|  | 3'-AGACCUUCUUUAAGCUCGACGACGGGU-5' | (SEQ ID NO: 507) |  |
| MYC-742 Target: | 5'-TCTGGAAGAAATTCGAGCTGCTGCCCA-3' | (SEQ ID NO: 834) |  |
|  | 5'-GGAAGAAAUUCGAGCUGCUGCCCAC-3' | (SEQ ID NO: 1162) |  |
|  | 3'-GACCUUCUUUAAGCUCGACGACGGGUG-5' | (SEQ ID NO: 508) |  |
| MYC-743 Target: | 5'-CTGGAAGAAATTCGAGCTGCTGCCCAC-3' | (SEQ ID NO: 835) |  |
|  | 5'-AGCCGCCGCUCCGGGCUCUGCUCGC-3' | (SEQ ID NO: 1163) |  |
|  | 3'-GAUCGGCGGCGAGGCCCGAGACGAGCG-5' | (SEQ ID NO: 509) |  |
| MYC-784 Target: | 5'-CTAGCCGCCGCTCCGGGCTCTGCTCGC-3' | (SEQ ID NO: 836) |  |
|  | 5'-GCCGCCGCUCCGGGCUCUGCUCGCC-3' | (SEQ ID NO: 1164) |  |
|  | 3'-AUCGGCGGCGAGGCCCGAGACGAGCGG-5' | (SEQ ID NO: 510) |  |
| MYC-785 Target: | 5'-TAGCCGCCGCTCCGGGCTCTGCTCGCC-3' | (SEQ ID NO: 837) |  |
|  | 5'-CCGCCGCUCCGGGCUCUGCUCGCCC-3' | (SEQ ID NO: 1165) |  |
|  | 3'-UCGGCGGCGAGGCCCGAGACGAGCGGG-5' | (SEQ ID NO: 511) |  |
| MYC-786 Target: | 5'-AGCCGCCGCTCCGGGCTCTGCTCGCCC-3' | (SEQ ID NO: 838) |  |
|  | 5'-CGCCGCUCCGGGCUCUGCUCGCCCU-3' | (SEQ ID NO: 1166) |  |
|  | 3'-CGGCGGCGAGGCCCGAGACGAGCGGGA-5' | (SEQ ID NO: 512) |  |
| MYC-787 Target: | 5'-GCCGCCGCTCCGGGCTCTGCTCGCCCT-3' | (SEQ ID NO: 839) |  |

TABLE 3-continued

Selected Human Anti-MYC DsiRNAs, Unmodified Duplexes (Asymmetrics)

|  |  |  |  |
|---|---|---|---|
|  | 5'-GCCGCUCCGGGCUCUGCUCGCCCUC-3' | (SEQ ID NO: 1167) |  |
|  | 3'-GGCGGCGAGGCCCGAGACGAGCGGGAG-5' | (SEQ ID NO: 513) |  |
| MYC-788 Target: | 5'-CCGCCGCTCCGGGCTCTGCTCGCCCTC-3' | (SEQ ID NO: 840) |  |
|  | 5'-GGAGGAGACAUGGUGAACCAGAGUU-3' | (SEQ ID NO: 1168) |  |
|  | 3'-ACCCUCCUCUGUACCACUUGGUCUCAA-5' | (SEQ ID NO: 514) |  |
| MYC-913 Target: | 5'-TGGGAGGAGACATGGTGAACCAGAGTT-3' | (SEQ ID NO: 841) |  |
|  | 5'-GAGGAGACAUGGUGAACCAGAGUUU-3' | (SEQ ID NO: 1169) |  |
|  | 3'-CCCUCCUCUGUACCACUUGGUCUCAAA-5' | (SEQ ID NO: 515) |  |
| MYC-914 Target: | 5'-GGGAGGAGACATGGTGAACCAGAGTTT-3' | (SEQ ID NO: 842) |  |
|  | 5'-AGGAGACAUGGUGAACCAGAGUUUC-3' | (SEQ ID NO: 1170) |  |
|  | 3'-CCUCCUCUGUACCACUUGGUCUCAAAG-5' | (SEQ ID NO: 516) |  |
| MYC-915 Target: | 5'-GGAGGAGACATGGTGAACCAGAGTTTC-3' | (SEQ ID NO: 843) |  |
|  | 5'-GGAGACAUGGUGAACCAGAGUUUCA-3' | (SEQ ID NO: 1171) |  |
|  | 3'-CUCCUCUGUACCACUUGGUCUCAAAGU-5' | (SEQ ID NO: 517) |  |
| MYC-916 Target: | 5'-GAGGAGACATGGTGAACCAGAGTTTCA-3' | (SEQ ID NO: 844) |  |
|  | 5'-GAGACAUGGUGAACCAGAGUUUCAU-3' | (SEQ ID NO: 1172) |  |
|  | 3'-UCCUCUGUACCACUUGGUCUCAAAGUA-5' | (SEQ ID NO: 518) |  |
| MYC-917 Target: | 5'-AGGAGACATGGTGAACCAGAGTTTCAT-3' | (SEQ ID NO: 845) |  |
|  | 5'-GACGACGAGACCUUCAUCAAAAACA-3' | (SEQ ID NO: 1173) |  |
|  | 3'-GCCUGCUGCUCUGGAAGUAGUUUUUGU-5' | (SEQ ID NO: 519) |  |
| MYC-952 Target: | 5'-CGGACGACGAGACCTTCATCAAAAACA-3' | (SEQ ID NO: 846) |  |
|  | 5'-ACGACGAGACCUUCAUCAAAAACAU-3' | (SEQ ID NO: 1174) |  |
|  | 3'-CCUGCUGCUCUGGAAGUAGUUUUUGUA-5' | (SEQ ID NO: 520) |  |
| MYC-953 Target: | 5'-GGACGACGAGACCTTCATCAAAAACAT-3' | (SEQ ID NO: 847) |  |
|  | 5'-AACAUCAUCAUCCAGGACUGUAUGU-3' | (SEQ ID NO: 1175) |  |
|  | 3'-UUUUGUAGUAGUAGGUCCUGACAUACA-5' | (SEQ ID NO: 521) |  |
| MYC-973 Target: | 5'-AAAACATCATCATCCAGGACTGTATGT-3' | (SEQ ID NO: 848) |  |
|  | 5'-ACAUCAUCAUCCAGGACUGUAUGUG-3' | (SEQ ID NO: 1176) |  |
|  | 3'-UUUGUAGUAGUAGGUCCUGACAUACAC-5' | (SEQ ID NO: 522) |  |
| MYC-974 Target: | 5'-AAACATCATCATCCAGGACTGTATGTG-3' | (SEQ ID NO: 849) |  |
|  | 5'-CAUCAUCAUCCAGGACUGUAUGUGG-3' | (SEQ ID NO: 1177) |  |
|  | 3'-UUGUAGUAGUAGGUCCUGACAUACACC-5' | (SEQ ID NO: 523) |  |
| MYC-975 Target: | 5'-AACATCATCATCCAGGACTGTATGTGG-3' | (SEQ ID NO: 850) |  |
|  | 5'-AUCAUCAUCCAGGACUGUAUGUGGA-3' | (SEQ ID NO: 1178) |  |
|  | 3'-UGUAGUAGUAGGUCCUGACAUACACCU-5' | (SEQ ID NO: 524) |  |
| MYC-976 Target: | 5'-ACATCATCATCCAGGACTGTATGTGGA-3' | (SEQ ID NO: 851) |  |
|  | 5'-UCAUCAUCCAGGACUGUAUGUGGAG-3' | (SEQ ID NO: 1179) |  |
|  | 3'-GUAGUAGUAGGUCCUGACAUACACCUC-5' | (SEQ ID NO: 525) |  |
| MYC-977 Target: | 5'-CATCATCATCCAGGACTGTATGTGGAG-3' | (SEQ ID NO: 852) |  |

TABLE 3-continued

Selected Human Anti-MYC DsiRNAs, Unmodified Duplexes (Asymmetrics)

```
                    5'-CAUCAUCCAGGACUGUAUGUGGAGC-3'    (SEQ ID NO: 1180)
                    3'-UAGUAGUAGGUCCUGACAUACACCUCG-5'  (SEQ ID NO: 526)
MYC-978  Target:    5'-ATCATCATCCAGGACTGTATGTGGAGC-3'  (SEQ ID NO: 853)
                    5'-AUCAUCCAGGACUGUAUGUGGAGCG-3'    (SEQ ID NO: 1181)
                    3'-AGUAGUAGGUCCUGACAUACACCUCGC-5'  (SEQ ID NO: 527)
MYC-979  Target:    5'-TCATCATCCAGGACTGTATGTGGAGCG-3'  (SEQ ID NO: 854)
                    5'-UCAUCCAGGACUGUAUGUGGAGCGG-3'    (SEQ ID NO: 1182)
                    3'-GUAGUAGGUCCUGACAUACACCUCGCC-5'  (SEQ ID NO: 528)
MYC-980  Target:    5'-CATCATCCAGGACTGTATGTGGAGCGG-3'  (SEQ ID NO: 855)
                    5'-CAUCCAGGACUGUAUGUGGAGCGGC-3'    (SEQ ID NO: 1183)
                    3'-UAGUAGGUCCUGACAUACACCUCGCCG-5'  (SEQ ID NO: 529)
MYC-981  Target:    5'-ATCATCCAGGACTGTATGTGGAGCGGC-3'  (SEQ ID NO: 856)
                    5'-AUCCAGGACUGUAUGUGGAGCGGCU-3'    (SEQ ID NO: 1184)
                    3'-AGUAGGUCCUGACAUACACCUCGCCGA-5'  (SEQ ID NO: 530)
MYC-982  Target:    5'-TCATCCAGGACTGTATGTGGAGCGGCT-3'  (SEQ ID NO: 857)
                    5'-UCCAGGACUGUAUGUGGAGCGGCUU-3'    (SEQ ID NO: 1185)
                    3'-GUAGGUCCUGACAUACACCUCGCCGAA-5'  (SEQ ID NO: 531)
MYC-983  Target:    5'-CATCCAGGACTGTATGTGGAGCGGCTT-3'  (SEQ ID NO: 858)
                    5'-CCAGGACUGUAUGUGGAGCGGCUUC-3'    (SEQ ID NO: 1186)
                    3'-UAGGUCCUGACAUACACCUCGCCGAAG-5'  (SEQ ID NO: 532)
MYC-984  Target:    5'-ATCCAGGACTGTATGTGGAGCGGCTTC-3'  (SEQ ID NO: 859)
                    5'-CAGGACUGUAUGUGGAGCGGCUUCU-3'    (SEQ ID NO: 1187)
                    3'-AGGUCCUGACAUACACCUCGCCGAAGA-5'  (SEQ ID NO: 533)
MYC-985  Target:    5'-TCCAGGACTGTATGTGGAGCGGCTTCT-3'  (SEQ ID NO: 860)
                    5'-AGGACUGUAUGUGGAGCGGCUUCUC-3'    (SEQ ID NO: 1188)
                    3'-GGUCCUGACAUACACCUCGCCGAAGAG-5'  (SEQ ID NO: 534)
MYC-986  Target:    5'-CCAGGACTGTATGTGGAGCGGCTTCTC-3'  (SEQ ID NO: 861)
                    5'-GAGAAGCUGGCCUCCUACCAGGCUG-3'    (SEQ ID NO: 1189)
                    3'-GUCUCUUCGACCGGAGGAUGGUCCGAC-5'  (SEQ ID NO: 535)
MYC-1033 Target:    5'-CAGAGAAGCTGGCCTCCTACCAGGCTG-3'  (SEQ ID NO: 862)
                    5'-AGAAGCUGGCCUCCUACCAGGCUGC-3'    (SEQ ID NO: 1190)
                    3'-UCUCUUCGACCGGAGGAUGGUCCGACG-5'  (SEQ ID NO: 536)
MYC-1034 Target:    5'-AGAGAAGCTGGCCTCCTACCAGGCTGC-3'  (SEQ ID NO: 863)
                    5'-GAAGCUGGCCUCCUACCAGGCUGCG-3'    (SEQ ID NO: 1191)
                    3'-CUCUUCGACCGGAGGAUGGUCCGACGC-5'  (SEQ ID NO: 537)
MYC-1035 Target:    5'-GAGAAGCTGGCCTCCTACCAGGCTGCG-3'  (SEQ ID NO: 864)
                    5'-AAGCUGGCCUCCUACCAGGCUGCGC-3'    (SEQ ID NO: 1192)
                    3'-UCUUCGACCGGAGGAUGGUCCGACGCG-5'  (SEQ ID NO: 538)
MYC-1036 Target:    5'-AGAAGCTGGCCTCCTACCAGGCTGCGC-3'  (SEQ ID NO: 865)
```

TABLE 3-continued

Selected Human Anti-MYC DsiRNAs, Unmodified Duplexes (Asymmetrics)

```
                          5'-AGCUGGCCUCCUACCAGGCUGCGCG-3'    (SEQ ID NO: 1193)
                          3'-CUUCGACCGGAGGAUGGUCCGACGCGC-5'  (SEQ ID NO: 539)

MYC-1037 Target:  5'-GAAGCTGGCCTCCTACCAGGCTGCGCG-3'          (SEQ ID NO: 866)
                          5'-GCUGGCCUCCUACCAGGCUGCGCGC-3'    (SEQ ID NO: 1194)
                          3'-UUCGACCGGAGGAUGGUCCGACGCGCG-5'  (SEQ ID NO: 540)

MYC-1038 Target:  5'-AAGCTGGCCTCCTACCAGGCTGCGCGC-3'          (SEQ ID NO: 867)
                          5'-CUGGCCUCCUACCAGGCUGCGCGCA-3'    (SEQ ID NO: 1195)
                          3'-UCGACCGGAGGAUGGUCCGACGCGCGU-5'  (SEQ ID NO: 541)

MYC-1039 Target:  5'-AGCTGGCCTCCTACCAGGCTGCGCGCA-3'          (SEQ ID NO: 868)
                          5'-UGGCCUCCUACCAGGCUGCGCGCAA-3'    (SEQ ID NO: 1196)
                          3'-CGACCGGAGGAUGGUCCGACGCGCGUU-5'  (SEQ ID NO: 542)

MYC-1040 Target:  5'-GCTGGCCTCCTACCAGGCTGCGCGCAA-3'          (SEQ ID NO: 869)
                          5'-GGCCUCCUACCAGGCUGCGCGCAAA-3'    (SEQ ID NO: 1197)
                          3'-GACCGGAGGAUGGUCCGACGCGCGUUU-5'  (SEQ ID NO: 543)

MYC-1041 Target:  5'-CTGGCCTCCTACCAGGCTGCGCGCAAA-3'          (SEQ ID NO: 870)
                          5'-GCCUCCUACCAGGCUGCGCGCAAAG-3'    (SEQ ID NO: 1198)
                          3'-ACCGGAGGAUGGUCCGACGCGCGUUUC-5'  (SEQ ID NO: 544)

MYC-1042 Target:  5'-TGGCCTCCTACCAGGCTGCGCGCAAAG-3'          (SEQ ID NO: 871)
                          5'-CCUCCUACCAGGCUGCGCGCAAAGA-3'    (SEQ ID NO: 1199)
                          3'-CCGGAGGAUGGUCCGACGCGCGUUUCU-5'  (SEQ ID NO: 545)

MYC-1043 Target:  5'-GGCCTCCTACCAGGCTGCGCGCAAAGA-3'          (SEQ ID NO: 872)
                          5'-CUCCUACCAGGCUGCGCGCAAAGAC-3'    (SEQ ID NO: 1200)
                          3'-CGGAGGAUGGUCCGACGCGCGUUUCUG-5'  (SEQ ID NO: 546)

MYC-1044 Target:  5'-GCCTCCTACCAGGCTGCGCGCAAAGAC-3'          (SEQ ID NO: 873)
                          5'-UCCUACCAGGCUGCGCGCAAAGACA-3'    (SEQ ID NO: 1201)
                          3'-GGAGGAUGGUCCGACGCGCGUUUCUGU-5'  (SEQ ID NO: 547)

MYC-1045 Target:  5'-CCTCCTACCAGGCTGCGCGCAAAGACA-3'          (SEQ ID NO: 874)
                          5'-CCUACCAGGCUGCGCGCAAAGACAG-3'    (SEQ ID NO: 1202)
                          3'-GAGGAUGGUCCGACGCGCGUUUCUGUC-5'  (SEQ ID NO: 548)

MYC-1046 Target:  5'-CTCCTACCAGGCTGCGCGCAAAGACAG-3'          (SEQ ID NO: 875)
                          5'-CUACCAGGCUGCGCGCAAAGACAGC-3'    (SEQ ID NO: 1203)
                          3'-AGGAUGGUCCGACGCGCGUUUCUGUCG-5'  (SEQ ID NO: 549)

MYC-1047 Target:  5'-TCCTACCAGGCTGCGCGCAAAGACAGC-3'          (SEQ ID NO: 876)
                          5'-UACCAGGCUGCGCGCAAAGACAGCG-3'    (SEQ ID NO: 1204)
                          3'-GGAUGGUCCGACGCGCGUUUCUGUCGC-5'  (SEQ ID NO: 550)

MYC-1048 Target:  5'-CCTACCAGGCTGCGCGCAAAGACAGCG-3'          (SEQ ID NO: 877)
                          5'-ACCAGGCUGCGCGCAAAGACAGCGG-3'    (SEQ ID NO: 1205)
                          3'-GAUGGUCCGACGCGCGUUUCUGUCGCC-5'  (SEQ ID NO: 551)

MYC-1049 Target:  5'-CTACCAGGCTGCGCGCAAAGACAGCGG-3'          (SEQ ID NO: 878)
```

TABLE 3-continued

Selected Human Anti-MYC DsiRNAs, Unmodified Duplexes (Asymmetrics)

```
                       5'-CCAGGCUGCGCGCAAAGACAGCGGC-3'    (SEQ ID NO: 1206)
                       3'-AUGGUCCGACGCGCGUUUCUGUCGCCG-5'  (SEQ ID NO: 552)
MYC-1050 Target:       5'-TACCAGGCTGCGCGCAAAGACAGCGGC-3'  (SEQ ID NO: 879)
                       5'-CAGGCUGCGCGCAAAGACAGCGGCA-3'    (SEQ ID NO: 1207)
                       3'-UGGUCCGACGCGCGUUUCUGUCGCCGU-5'  (SEQ ID NO: 553)
MYC-1051 Target:       5'-ACCAGGCTGCGCGCAAAGACAGCGGCA-3'  (SEQ ID NO: 880)
                       5'-AGGCUGCGCGCAAAGACAGCGGCAG-3'    (SEQ ID NO: 1208)
                       3'-GGUCCGACGCGCGUUUCUGUCGCCGUC-5'  (SEQ ID NO: 554)
MYC-1052 Target:       5'-CCAGGCTGCGCGCAAAGACAGCGGCAG-3'  (SEQ ID NO: 881)
                       5'-GGCUGCGCGCAAAGACAGCGGCAGC-3'    (SEQ ID NO: 1209)
                       3'-GUCCGACGCGCGUUUCUGUCGCCGUCG-5'  (SEQ ID NO: 555)
MYC-1053 Target:       5'-CAGGCTGCGCGCAAAGACAGCGGCAGC-3'  (SEQ ID NO: 882)
                       5'-CACAGCGUCUGCUCCACCUCCAGCU-3'    (SEQ ID NO: 1210)
                       3'-CGGUGUCGCAGACGAGGUGGAGGUCGA-5'  (SEQ ID NO: 556)
MYC-1096 Target:       5'-GCCACAGCGTCTGCTCCACCTCCAGCT-3'  (SEQ ID NO: 883)
                       5'-ACAGCGUCUGCUCCACCUCCAGCUU-3'    (SEQ ID NO: 1211)
                       3'-GGUGUCGCAGACGAGGUGGAGGUCGAA-5'  (SEQ ID NO: 557)
MYC-1097 Target:       5'-CCACAGCGTCTGCTCCACCTCCAGCTT-3'  (SEQ ID NO: 884)
                       5'-CAGCGUCUGCUCCACCUCCAGCUUG-3'    (SEQ ID NO: 1212)
                       3'-GUGUCGCAGACGAGGUGGAGGUCGAAC-5'  (SEQ ID NO: 558)
MYC-1098 Target:       5'-CACAGCGTCTGCTCCACCTCCAGCTTG-3'  (SEQ ID NO: 885)
                       5'-AGCGUCUGCUCCACCUCCAGCUUGU-3'    (SEQ ID NO: 1213)
                       3'-UGUCGCAGACGAGGUGGAGGUCGAACA-5'  (SEQ ID NO: 559)
MYC-1099 Target:       5'-ACAGCGTCTGCTCCACCTCCAGCTTGT-3'  (SEQ ID NO: 886)
                       5'-GCGUCUGCUCCACCUCCAGCUUGUA-3'    (SEQ ID NO: 1214)
                       3'-GUCGCAGACGAGGUGGAGGUCGAACAU-5'  (SEQ ID NO: 560)
MYC-1100 Target:       5'-CAGCGTCTGCTCCACCTCCAGCTTGTA-3'  (SEQ ID NO: 887)
                       5'-CGUCUGCUCCACCUCCAGCUUGUAC-3'    (SEQ ID NO: 1215)
                       3'-UCGCAGACGAGGUGGAGGUCGAACAUG-5'  (SEQ ID NO: 561)
MYC-1101 Target:       5'-AGCGTCTGCTCCACCTCCAGCTTGTAC-3'  (SEQ ID NO: 888)
                       5'-CUCAACGACAGCAGCUCGCCCAAGU-3'    (SEQ ID NO: 1216)
                       3'-GAGAGUUGCUGUCGUCGAGCGGGUUCA-5'  (SEQ ID NO: 562)
MYC-1189 Target:       5'-CTCTCAACGACAGCAGCTCGCCCAAGT-3'  (SEQ ID NO: 889)
                       5'-UCAACGACAGCAGCUCGCCCAAGUC-3'    (SEQ ID NO: 1217)
                       3'-AGAGUUGCUGUCGUCGAGCGGGUUCAG-5'  (SEQ ID NO: 563)
MYC-1190 Target:       5'-TCTCAACGACAGCAGCTCGCCCAAGTC-3'  (SEQ ID NO: 890)
                       5'-CAACGACAGCAGCUCGCCCAAGUCC-3'    (SEQ ID NO: 1218)
                       3'-GAGUUGCUGUCGUCGAGCGGGUUCAGG-5'  (SEQ ID NO: 564)
MYC-1191 Target:       5'-CTCAACGACAGCAGCTCGCCCAAGTCC-3'  (SEQ ID NO: 891)
```

TABLE 3-continued

Selected Human Anti-MYC DsiRNAs, Unmodified Duplexes (Asymmetrics)

|  |  |  |
|---|---|---|
|  | 5'-AACGACAGCAGCUCGCCCAAGUCCU-3' | (SEQ ID NO: 1219) |
|  | 3'-AGUUGCUGUCGUCGAGCGGGUUCAGGA-5' | (SEQ ID NO: 565) |
| MYC-1192 Target: | 5'-TCAACGACAGCAGCTCGCCCAAGTCCT-3' | (SEQ ID NO: 892) |
|  | 5'-ACGACAGCAGCUCGCCCAAGUCCUG-3' | (SEQ ID NO: 1220) |
|  | 3'-GUUGCUGUCGUCGAGCGGGUUCAGGAC-5' | (SEQ ID NO: 566) |
| MYC-1193 Target: | 5'-CAACGACAGCAGCTCGCCCAAGTCCTG-3' | (SEQ ID NO: 893) |
|  | 5'-CAUGAGGAGACACCGCCCACCACCA-3' | (SEQ ID NO: 1221) |
|  | 3'-AGGUACUCCUCUGUGGCGGGUGGUGGU-5' | (SEQ ID NO: 567) |
| MYC-1315 Target: | 5'-TCCATGAGGAGACACCGCCCACCACCA-3' | (SEQ ID NO: 894) |
|  | 5'-AUGAGGAGACACCGCCCACCACCAG-3' | (SEQ ID NO: 1222) |
|  | 3'-GGUACUCCUCUGUGGCGGGUGGUGGUC-5' | (SEQ ID NO: 568) |
| MYC-1316 Target: | 5'-CCATGAGGAGACACCGCCCACCACCAG-3' | (SEQ ID NO: 895) |
|  | 5'-UGAGGAGACACCGCCCACCACCAGC-3' | (SEQ ID NO: 1223) |
|  | 3'-GUACUCCUCUGUGGCGGGUGGUGGUCG-5' | (SEQ ID NO: 569) |
| MYC-1317 Target: | 5'-CATGAGGAGACACCGCCCACCACCAGC-3' | (SEQ ID NO: 896) |
|  | 5'-GAGGAGACACCGCCCACCACCAGCA-3' | (SEQ ID NO: 1224) |
|  | 3'-UACUCCUCUGUGGCGGGUGGUGGUCGU-5' | (SEQ ID NO: 570) |
| MYC-1318 Target: | 5'-ATGAGGAGACACCGCCCACCACCAGCA-3' | (SEQ ID NO: 897) |
|  | 5'-AGGAGACACCGCCCACCACCAGCAG-3' | (SEQ ID NO: 1225) |
|  | 3'-ACUCCUCUGUGGCGGGUGGUGGUCGUC-5' | (SEQ ID NO: 571) |
| MYC-1319 Target: | 5'-TGAGGAGACACCGCCCACCACCAGCAG-3' | (SEQ ID NO: 898) |
|  | 5'-GGAGACACCGCCCACCACCAGCAGC-3' | (SEQ ID NO: 1226) |
|  | 3'-CUCCUCUGUGGCGGGUGGUGGUCGUCG-5' | (SEQ ID NO: 572) |
| MYC-1320 Target: | 5'-GAGGAGACACCGCCCACCACCAGCAGC-3' | (SEQ ID NO: 899) |
|  | 5'-GAGACACCGCCCACCACCAGCAGCG-3' | (SEQ ID NO: 1227) |
|  | 3'-UCCUCUGUGGCGGGUGGUGGUCGUCGC-5' | (SEQ ID NO: 573) |
| MYC-1321 Target: | 5'-AGGAGACACCGCCCACCACCAGCAGCG-3' | (SEQ ID NO: 900) |
|  | 5'-AGACACCGCCCACCACCAGCAGCGA-3' | (SEQ ID NO: 1228) |
|  | 3'-CCUCUGUGGCGGGUGGUGGUCGUCGCU-5' | (SEQ ID NO: 574) |
| MYC-1322 Target: | 5'-GGAGACACCGCCCACCACCAGCAGCGA-3' | (SEQ ID NO: 901) |
|  | 5'-GACACCGCCCACCACCAGCAGCGAC-3' | (SEQ ID NO: 1229) |
|  | 3'-CUCUGUGGCGGGUGGUGGUCGUCGCUG-5' | (SEQ ID NO: 575) |
| MYC-1323 Target: | 5'-GAGACACCGCCCACCACCAGCAGCGAC-3' | (SEQ ID NO: 902) |
|  | 5'-ACACCGCCCACCACCAGCAGCGACU-3' | (SEQ ID NO: 1230) |
|  | 3'-UCUGUGGCGGGUGGUGGUCGUCGCUGA-5' | (SEQ ID NO: 576) |
| MYC-1324 Target: | 5'-AGACACCGCCCACCACCAGCAGCGACT-3' | (SEQ ID NO: 903) |
|  | 5'-CACCGCCCACCACCAGCAGCGACUC-3' | (SEQ ID NO: 1231) |
|  | 3'-CUGUGGCGGGUGGUGGUCGUCGCUGAG-5' | (SEQ ID NO: 577) |
| MYC-1325 Target: | 5'-GACACCGCCCACCACCAGCAGCGACTC-3' | (SEQ ID NO: 904) |

TABLE 3-continued

Selected Human Anti-MYC DsiRNAs, Unmodified Duplexes (Asymmetrics)

|  |  |  |
|---|---|---|
|  | 5'-ACCGCCCACCACCAGCAGCGACUCU-3' | (SEQ ID NO: 1232) |
|  | 3'-UGUGGCGGGUGGUGGUCGUCGCUGAGA-5' | (SEQ ID NO: 578) |
| MYC-1326 Target: | 5'-ACACCGCCCACCACCAGCAGCGACTCT-3' | (SEQ ID NO: 905) |
|  | 5'-CCGCCCACCACCAGCAGCGACUCUG-3' | (SEQ ID NO: 1233) |
|  | 3'-GUGGCGGGUGGUGGUCGUCGCUGAGAC-5' | (SEQ ID NO: 579) |
| MYC-1327 Target: | 5'-CACCGCCCACCACCAGCAGCGACTCTG-3' | (SEQ ID NO: 906) |
|  | 5'-CGCCCACCACCAGCAGCGACUCUGA-3' | (SEQ ID NO: 1234) |
|  | 3'-UGGCGGGUGGUGGUCGUCGCUGAGACU-5' | (SEQ ID NO: 580) |
| MYC-1328 Target: | 5'-ACCGCCCACCACCAGCAGCGACTCTGA-3' | (SEQ ID NO: 907) |
|  | 5'-GCCCACCACCAGCAGCGACUCUGAG-3' | (SEQ ID NO: 1235) |
|  | 3'-GGCGGGUGGUGGUCGUCGCUGAGACUC-5' | (SEQ ID NO: 581) |
| MYC-1329 Target: | 5'-CCGCCCACCACCAGCAGCGACTCTGAG-3' | (SEQ ID NO: 908) |
|  | 5'-CCCACCACCAGCAGCGACUCUGAGG-3' | (SEQ ID NO: 1236) |
|  | 3'-GCGGGUGGUGGUCGUCGCUGAGACUCC-5' | (SEQ ID NO: 582) |
| MYC-1330 Target: | 5'-CGCCCACCACCAGCAGCGACTCTGAGG-3' | (SEQ ID NO: 909) |
|  | 5'-CCACCACCAGCAGCGACUCUGAGGA-3' | (SEQ ID NO: 1237) |
|  | 3'-CGGGUGGUGGUCGUCGCUGAGACUCCU-5' | (SEQ ID NO: 583) |
| MYC-1331 Target: | 5'-GCCCACCACCAGCAGCGACTCTGAGGA-3' | (SEQ ID NO: 910) |
|  | 5'-CACCACCAGCAGCGACUCUGAGGAG-3' | (SEQ ID NO: 1238) |
|  | 3'-GGGUGGUGGUCGUCGCUGAGACUCCUC-5' | (SEQ ID NO: 584) |
| MYC-1332 Target: | 5'-CCCACCACCAGCAGCGACTCTGAGGAG-3' | (SEQ ID NO: 911) |
|  | 5'-ACCACCAGCAGCGACUCUGAGGAGG-3' | (SEQ ID NO: 1239) |
|  | 3'-GGUGGUGGUCGUCGCUGAGACUCCUCC-5' | (SEQ ID NO: 585) |
| MYC-1333 Target: | 5'-CCACCACCAGCAGCGACTCTGAGGAGG-3' | (SEQ ID NO: 912) |
|  | 5'-CCACCAGCAGCGACUCUGAGGAGGA-3' | (SEQ ID NO: 1240) |
|  | 3'-GUGGUGGUCGUCGCUGAGACUCCUCCU-5' | (SEQ ID NO: 586) |
| MYC-1334 Target: | 5'-CACCACCAGCAGCGACTCTGAGGAGGA-3' | (SEQ ID NO: 913) |
|  | 5'-CAAGAAGAUGAGGAAGAAAUCGAUG-3' | (SEQ ID NO: 1241) |
|  | 3'-UUGUUCUUCUACUCCUUCUUUAGCUAC-5' | (SEQ ID NO: 587) |
| MYC-1360 Target: | 5'-AACAAGAAGATGAGGAAGAAATCGATG-3' | (SEQ ID NO: 914) |
|  | 5'-AAGAAGAUGAGGAAGAAAUCGAUGU-3' | (SEQ ID NO: 1242) |
|  | 3'-UGUUCUUCUACUCCUUCUUUAGCUACA-5' | (SEQ ID NO: 588) |
| MYC-1361 Target: | 5'-ACAAGAAGATGAGGAAGAAATCGATGT-3' | (SEQ ID NO: 915) |
|  | 5'-GAGGCCACAGCAAACCUCCUCACAG-3' | (SEQ ID NO: 1243) |
|  | 3'-ACCUCCGGUGUCGUUUGGAGGAGUGUC-5' | (SEQ ID NO: 589) |
| MYC-1448 Target: | 5'-TGGAGGCCACAGCAAACCTCCTCACAG-3' | (SEQ ID NO: 916) |
|  | 5'-CACAGCCCACUGGUCCUCAAGAGGU-3' | (SEQ ID NO: 1244) |
|  | 3'-GAGUGUCGGGUGACCAGGAGUUCUCCA-5' | (SEQ ID NO: 590) |
| MYC-1468 Target: | 5'-CTCACAGCCCACTGGTCCTCAAGAGGT-3' | (SEQ ID NO: 917) |

TABLE 3-continued

Selected Human Anti-MYC DsiRNAs, Unmodified Duplexes (Asymmetrics)

```
                           5'-ACAGCCCACUGGUCCUCAAGAGGUG-3'       (SEQ ID NO: 1245)
                           3'-AGUGUCGGGUGACCAGGAGUUCUCCAC-5'     (SEQ ID NO: 591)
MYC-1469 Target: 5'-TCACAGCCCACTGGTCCTCAAGAGGTG-3'                (SEQ ID NO: 918)
                           5'-CAGCCCACUGGUCCUCAAGAGGUGC-3'       (SEQ ID NO: 1246)
                           3'-GUGUCGGGUGACCAGGAGUUCUCCACG-5'     (SEQ ID NO: 592)
MYC-1470 Target: 5'-CACAGCCCACTGGTCCTCAAGAGGTGC-3'                (SEQ ID NO: 919)
                           5'-AGCCCACUGGUCCUCAAGAGGUGCC-3'       (SEQ ID NO: 1247)
                           3'-UGUCGGGUGACCAGGAGUUCUCCACGG-5'     (SEQ ID NO: 593)
MYC-1471 Target: 5'-ACAGCCCACTGGTCCTCAAGAGGTGCC-3'                (SEQ ID NO: 920)
                           5'-GCCCACUGGUCCUCAAGAGGUGCCA-3'       (SEQ ID NO: 1248)
                           3'-GUCGGGUGACCAGGAGUUCUCCACGGU-5'     (SEQ ID NO: 594)
MYC-1472 Target: 5'-CAGCCCACTGGTCCTCAAGAGGTGCCA-3'                (SEQ ID NO: 921)
                           5'-CCCACUGGUCCUCAAGAGGUGCCAC-3'       (SEQ ID NO: 1249)
                           3'-UCGGGUGACCAGGAGUUCUCCACGGUG-5'     (SEQ ID NO: 595)
MYC-1473 Target: 5'-AGCCCACTGGTCCTCAAGAGGTGCCAC-3'                (SEQ ID NO: 922)
                           5'-CCACUGGUCCUCAAGAGGUGCCACG-3'       (SEQ ID NO: 1250)
                           3'-CGGGUGACCAGGAGUUCUCCACGGUGC-5'     (SEQ ID NO: 596)
MYC-1474 Target: 5'-GCCCACTGGTCCTCAAGAGGTGCCACG-3'                (SEQ ID NO: 923)
                           5'-CACUGGUCCUCAAGAGGUGCCACGU-3'       (SEQ ID NO: 1251)
                           3'-GGGUGACCAGGAGUUCUCCACGGUGCA-5'     (SEQ ID NO: 597)
MYC-1475 Target: 5'-CCCACTGGTCCTCAAGAGGTGCCACGT-3'                (SEQ ID NO: 924)
                           5'-ACUGGUCCUCAAGAGGUGCCACGUC-3'       (SEQ ID NO: 1252)
                           3'-GGUGACCAGGAGUUCUCCACGGUGCAG-5'     (SEQ ID NO: 598)
MYC-1476 Target: 5'-CCACTGGTCCTCAAGAGGTGCCACGTC-3'                (SEQ ID NO: 925)
                           5'-CUGGUCCUCAAGAGGUGCCACGUCU-3'       (SEQ ID NO: 1253)
                           3'-GUGACCAGGAGUUCUCCACGGUGCAGA-5'     (SEQ ID NO: 599)
MYC-1477 Target: 5'-CACTGGTCCTCAAGAGGTGCCACGTCT-3'                (SEQ ID NO: 926)
                           5'-UGGUCCUCAAGAGGUGCCACGUCUC-3'       (SEQ ID NO: 1254)
                           3'-UGACCAGGAGUUCUCCACGGUGCAGAG-5'     (SEQ ID NO: 600)
MYC-1478 Target: 5'-ACTGGTCCTCAAGAGGTGCCACGTCTC-3'                (SEQ ID NO: 927)
                           5'-GGUCCUCAAGAGGUGCCACGUCUCC-3'       (SEQ ID NO: 1255)
                           3'-GACCAGGAGUUCUCCACGGUGCAGAGG-5'     (SEQ ID NO: 601)
MYC-1479 Target: 5'-CTGGTCCTCAAGAGGTGCCACGTCTCC-3'                (SEQ ID NO: 928)
                           5'-GUCCUCAAGAGGUGCCACGUCUCCA-3'       (SEQ ID NO: 1256)
                           3'-ACCAGGAGUUCUCCACGGUGCAGAGGU-5'     (SEQ ID NO: 602)
MYC-1480 Target: 5'-TGGTCCTCAAGAGGTGCCACGTCTCCA-3'                (SEQ ID NO: 929)
                           5'-UCCUCAAGAGGUGCCACGUCUCCAC-3'       (SEQ ID NO: 1257)
                           3'-CCAGGAGUUCUCCACGGUGCAGAGGUG-5'     (SEQ ID NO: 603)
MYC-1481 Target: 5'-GGTCCTCAAGAGGTGCCACGTCTCCAC-3'                (SEQ ID NO: 930)
```

TABLE 3-continued

Selected Human Anti-MYC DsiRNAs, Unmodified Duplexes (Asymmetrics)

```
                    5'-CCUCAAGAGGUGCCACGUCUCCACA-3'    (SEQ ID NO: 1258)

3'-CAGGAGUUCUCCACGGUGCAGAGGUGU-5'  (SEQ ID NO: 604)

MYC-1482 Target:    5'-GTCCTCAAGAGGTGCCACGTCTCCACA-3'  (SEQ ID NO: 931)

5'-CUCAAGAGGUGCCACGUCUCCACAC-3'    (SEQ ID NO: 1259)

3'-AGGAGUUCUCCACGGUGCAGAGGUGUG-5'  (SEQ ID NO: 605)

MYC-1483 Target:    5'-TCCTCAAGAGGTGCCACGTCTCCACAC-3'  (SEQ ID NO: 932)

5'-AGCUUUUUUGCCCUGCGUGACCAGA-3'    (SEQ ID NO: 1260)

3'-CCUCGAAAAAACGGGACGCACUGGUCU-5'  (SEQ ID NO: 606)

MYC-1711 Target:    5'-GGAGCTTTTTTGCCCTGCGTGACCAGA-3'  (SEQ ID NO: 933)

5'-GCUUUUUUGCCCUGCGUGACCAGAU-3'    (SEQ ID NO: 1261)

3'-CUCGAAAAAACGGGACGCACUGGUCUA-5'  (SEQ ID NO: 607)

MYC-1712 Target:    5'-GAGCTTTTTTGCCCTGCGTGACCAGAT-3'  (SEQ ID NO: 934)

5'-CUUUUUUGCCCUGCGUGACCAGAUC-3'    (SEQ ID NO: 1262)

3'-UCGAAAAAACGGGACGCACUGGUCUAG-5'  (SEQ ID NO: 608)

MYC-1713 Target:    5'-AGCTTTTTTGCCCTGCGTGACCAGATC-3'  (SEQ ID NO: 935)

5'-UUUUUUGCCCUGCGUGACCAGAUCC-3'    (SEQ ID NO: 1263)

3'-CGAAAAAACGGGACGCACUGGUCUAGG-5'  (SEQ ID NO: 609)

MYC-1714 Target:    5'-GCTTTTTTGCCCTGCGTGACCAGATCC-3'  (SEQ ID NO: 936)

5'-UUUUUGCCCUGCGUGACCAGAUCCC-3'    (SEQ ID NO: 1264)

3'-GAAAAAACGGGACGCACUGGUCUAGGG-5'  (SEQ ID NO: 610)

MYC-1715 Target:    5'-CTTTTTTGCCCTGCGTGACCAGATCCC-3'  (SEQ ID NO: 937)

5'-UUUUGCCCUGCGUGACCAGAUCCCG-3'    (SEQ ID NO: 1265)

3'-AAAAAACGGGACGCACUGGUCUAGGGC-5'  (SEQ ID NO: 611)

MYC-1716 Target:    5'-TTTTTTGCCCTGCGTGACCAGATCCCG-3'  (SEQ ID NO: 938)

5'-UUUGCCCUGCGUGACCAGAUCCCGG-3'    (SEQ ID NO: 1266)

3'-AAAAACGGGACGCACUGGUCUAGGGCC-5'  (SEQ ID NO: 612)

MYC-1717 Target:    5'-TTTTTGCCCTGCGTGACCAGATCCCGG-3'  (SEQ ID NO: 939)

5'-UUGCCCUGCGUGACCAGAUCCCGGA-3'    (SEQ ID NO: 1267)

3'-AAAACGGGACGCACUGGUCUAGGGCCU-5'  (SEQ ID NO: 613)

MYC-1718 Target:    5'-TTTTGCCCTGCGTGACCAGATCCCGGA-3'  (SEQ ID NO: 940)

5'-UGCCCUGCGUGACCAGAUCCCGGAG-3'    (SEQ ID NO: 1268)

3'-AAACGGGACGCACUGGUCUAGGGCCUC-5'  (SEQ ID NO: 614)

MYC-1719 Target:    5'-TTTGCCCTGCGTGACCAGATCCCGGAG-3'  (SEQ ID NO: 941)

5'-GCCCUGCGUGACCAGAUCCCGGAGU-3'    (SEQ ID NO: 1269)

3'-AACGGGACGCACUGGUCUAGGGCCUCA-5'  (SEQ ID NO: 615)

MYC-1720 Target:    5'-TTGCCCTGCGTGACCAGATCCCGGAGT-3'  (SEQ ID NO: 942)

5'-CCCUGCGUGACCAGAUCCCGGAGUU-3'    (SEQ ID NO: 1270)

3'-ACGGGACGCACUGGUCUAGGGCCUCAA-5'  (SEQ ID NO: 616)

MYC-1721 Target:    5'-TGCCCTGCGTGACCAGATCCCGGAGTT-3'  (SEQ ID NO: 943)
```

TABLE 3-continued

Selected Human Anti-MYC DsiRNAs, Unmodified Duplexes (Asymmetrics)

```
                   5'-GGAAACGACGAGAACAGUUGAAACA-3'       (SEQ ID NO: 1271)

3'-CGCCUUUGCUGCUCUUGUCAACUUUGU-5'     (SEQ ID NO: 617)

MYC-1856 Target:   5'-GCGGAAACGACGAGAACAGTTGAAACA-3'    (SEQ ID NO: 944)

5'-GAAACGACGAGAACAGUUGAAACAC-3'       (SEQ ID NO: 1272)

3'-GCCUUUGCUGCUCUUGUCAACUUUGUG-5'    (SEQ ID NO: 618)

MYC-1857 Target:   5'-CGGAAACGACGAGAACAGTTGAAACAC-3'    (SEQ ID NO: 945)

5'-UUUAACAGAUUUGUAUUUAAGAAUU-3'       (SEQ ID NO: 1273)

3'-AGAAAUUGUCUAAACAUAAAUUCUUAA-5'    (SEQ ID NO: 619)

MYC-2115 Target:   5'-TCTTTAACAGATTTGTATTTAAGAATT-3'    (SEQ ID NO: 946)

5'-UUAACAGAUUUGUAUUUAAGAAUUG-3'       (SEQ ID NO: 1274)

3'-GAAAUUGUCUAAACAUAAAUUCUUAAC-5'    (SEQ ID NO: 620)

MYC-2116 Target:   5'-CTTTAACAGATTTGTATTTAAGAATTG-3'    (SEQ ID NO: 947)

5'-AAAUGUAAAUAACUUUAAUAAAACG-3'       (SEQ ID NO: 1275)

3'-AAUUUACAUUUAUUGAAAUUAUUUUGC-5'    (SEQ ID NO: 621)

MYC-2193 Target:   5'-TTAAATGTAAATAACTTTAATAAAACG-3'    (SEQ ID NO: 948)

5'-AAUGUAAAUAACUUUAAUAAAACGU-3'       (SEQ ID NO: 1276)

3'-AUUUACAUUUAUUGAAAUUAUUUUGCA-5'    (SEQ ID NO: 622)

MYC-2194 Target:   5'-TAAATGTAAATAACTTTAATAAAACGT-3'    (SEQ ID NO: 949)

5'-AUGUAAAUAACUUUAAUAAAACGUU-3'       (SEQ ID NO: 1277)

3'-UUUACAUUUAUUGAAAUUAUUUUGCAA-5'    (SEQ ID NO: 623)

MYC-2195 Target:   5'-AAATGTAAATAACTTTAATAAAACGTT-3'    (SEQ ID NO: 950)

5'-UGUAAAUAACUUUAAUAAAACGUUU-3'       (SEQ ID NO: 1278)

3'-UUACAUUUAUUGAAAUUAUUUUGCAAA-5'    (SEQ ID NO: 624)

MYC-2196 Target:   5'-AATGTAAATAACTTTAATAAAACGTTT-3'    (SEQ ID NO: 951)

5'-GUAAAUAACUUUAAUAAAACGUUUA-3'       (SEQ ID NO: 1279)

3'-UACAUUUAUUGAAAUUAUUUUGCAAAU-5'    (SEQ ID NO: 625)

MYC-2197 Target:   5'-ATGTAAATAACTTTAATAAAACGTTTA-3'    (SEQ ID NO: 952)

5'-UAAAUAACUUUAAUAAAACGUUUAU-3'       (SEQ ID NO: 1280)

3'-ACAUUUAUUGAAAUUAUUUUGCAAAUA-5'    (SEQ ID NO: 626)

MYC-2198 Target:   5'-TGTAAATAACTTTAATAAAACGTTTAT-3'    (SEQ ID NO: 953)

5'-AAAUAACUUUAAUAAAACGUUUAUA-3'       (SEQ ID NO: 1281)

3'-CAUUUAUUGAAAUUAUUUUGCAAAUAU-5'    (SEQ ID NO: 627)

MYC-2199 Target:   5'-GTAAATAACTTTAATAAAACGTTTATA-3'    (SEQ ID NO: 954)

5'-AAUAACUUUAAUAAAACGUUUAUAG-3'       (SEQ ID NO: 1282)

3'-AUUUAUUGAAAUUAUUUUGCAAAUAUC-5'    (SEQ ID NO: 628)

MYC-2200 Target:   5'-TAAATAACTTTAATAAAACGTTTATAG-3'    (SEQ ID NO: 955)

5'-AUAACUUUAAUAAAACGUUUAUAGC-3'       (SEQ ID NO: 1283)

3'-UUUAUUGAAAUUAUUUUGCAAAUAUCG-5'    (SEQ ID NO: 629)

MYC-2201 Target:   5'-AAATAACTTTAATAAAACGTTTATAGC-3'    (SEQ ID NO: 956)
```

TABLE 3-continued

Selected Human Anti-MYC DsiRNAs, Unmodified Duplexes (Asymmetrics)

|  |  |  |
|---|---|---|
|  | 5'-UAACUUUAAUAAAACGUUUAUAGCA-3' | (SEQ ID NO: 1284) |
|  | 3'-UUAUUGAAAUUAUUUUGCAAAUAUCGU-5' | (SEQ ID NO: 630) |
| MYC-2202 Target: | 5'-AATAACTTTAATAAAACGTTTATAGCA-3' | (SEQ ID NO: 957) |
|  | 5'-AACUUUAAUAAAACGUUUAUAGCAG-3' | (SEQ ID NO: 1285) |
|  | 3'-UAUUGAAAUUAUUUUGCAAAUAUCGUC-5' | (SEQ ID NO: 631) |
| MYC-2203 Target: | 5'-ATAACTTTAATAAAACGTTTATAGCAG-3' | (SEQ ID NO: 958) |
|  | 5'-ACUUUAAUAAAACGUUUAUAGCAGU-3' | (SEQ ID NO: 1286) |
|  | 3'-AUUGAAAUUAUUUUGCAAAUAUCGUCA-5' | (SEQ ID NO: 632) |
| MYC-2204 Target: | 5'-TAACTTTAATAAAACGTTTATAGCAGT-3' | (SEQ ID NO: 959) |
|  | 5'-CUUUAAUAAAACGUUUAUAGCAGUU-3' | (SEQ ID NO: 1287) |
|  | 3'-UUGAAAUUAUUUUGCAAAUAUCGUCAA-5' | (SEQ ID NO: 633) |
| MYC-2205 Target: | 5'-AACTTTAATAAAACGTTTATAGCAGTT-3' | (SEQ ID NO: 960) |
|  | 5'-UUUUUAAAGUUGAUUUUUUUCUAUU-3' | (SEQ ID NO: 1288) |
|  | 3'-CGAAAAAUUUCAACUAAAAAAAGAUAA-5' | (SEQ ID NO: 634) |
| MYC-2313 Target: | 5'-GCTTTTTAAAGTTGATTTTTTTCTATT-3' | (SEQ ID NO: 961) |
|  | 5'-UUUUAAAGUUGAUUUUUUUCUAUUG-3' | (SEQ ID NO: 1289) |
|  | 3'-GAAAAAUUUCAACUAAAAAAAGAUAAC-5' | (SEQ ID NO: 635) |
| MYC-2314 Target: | 5'-CTTTTTAAAGTTGATTTTTTTCTATTG-3' | (SEQ ID NO: 962) |
|  | 5'-UUUAAAGUUGAUUUUUUUCUAUUGU-3' | (SEQ ID NO: 1290) |
|  | 3'-AAAAAUUUCAACUAAAAAAAGAUAACA-5' | (SEQ ID NO: 636) |
| MYC-2315 Target: | 5'-TTTTTAAAGTTGATTTTTTTCTATTGT-3' | (SEQ ID NO: 963) |
|  | 5'-UUAAAGUUGAUUUUUUUCUAUUGUU-3' | (SEQ ID NO: 1291) |
|  | 3'-AAAAUUUCAACUAAAAAAAGAUAACAA-5' | (SEQ ID NO: 637) |
| MYC-2316 Target: | 5'-TTTTAAAGTTGATTTTTTTCTATTGTT-3' | (SEQ ID NO: 964) |
|  | 5'-UAAAGUUGAUUUUUUUCUAUUGUUU-3' | (SEQ ID NO: 1292) |
|  | 3'-AAAUUUCAACUAAAAAAAGAUAACAAA-5' | (SEQ ID NO: 638) |
| MYC-2317 Target: | 5'-TTTAAAGTTGATTTTTTTCTATTGTTT-3' | (SEQ ID NO: 965) |
|  | 5'-AAAGUUGAUUUUUUUCUAUUGUUUU-3' | (SEQ ID NO: 1293) |
|  | 3'-AAUUUCAACUAAAAAAAGAUAACAAAA-5' | (SEQ ID NO: 639) |
| MYC-2318 Target: | 5'-TTAAAGTTGATTTTTTTCTATTGTTTT-3' | (SEQ ID NO: 966) |
|  | 5'-AAGUUGAUUUUUUUCUAUUGUUUUU-3' | (SEQ ID NO: 1294) |
|  | 3'-AUUUCAACUAAAAAAAGAUAACAAAAA-5' | (SEQ ID NO: 640) |
| MYC-2319 Target: | 5'-TAAAGTTGATTTTTTTCTATTGTTTTT-3' | (SEQ ID NO: 967) |
|  | 5'-AGUUGAUUUUUUUCUAUUGUUUUUA-3' | (SEQ ID NO: 1295) |
|  | 3'-UUUCAACUAAAAAAAGAUAACAAAAAU-5' | (SEQ ID NO: 641) |
| MYC-2320 Target: | 5'-AAAGTTGATTTTTTTCTATTGTTTTTA-3' | (SEQ ID NO: 968) |
|  | 5'-GUUGAUUUUUUUCUAUUGUUUUUAG-3' | (SEQ ID NO: 1296) |
|  | 3'-UUCAACUAAAAAAAGAUAACAAAAAUC-5' | (SEQ ID NO: 642) |
| MYC-2321 Target: | 5'-AAGTTGATTTTTTTCTATTGTTTTTAG-3' | (SEQ ID NO: 969) |

TABLE 3-continued

Selected Human Anti-MYC DsiRNAs, Unmodified Duplexes (Asymmetrics)

|  |  |  |
|---|---|---|
|  | 5'-UUGAUUUUUUCUAUUGUUUUUAGA-3' | (SEQ ID NO: 1297) |
|  | 3'-UCAACUAAAAAAGAUAACAAAAAUCU-5' | (SEQ ID NO: 643) |
| MYC-2322 Target: | 5'-AGTTGATTTTTTCTATTGTTTTTAGA-3' | (SEQ ID NO: 970) |
|  | 5'-UGAUUUUUUCUAUUGUUUUUAGAA-3' | (SEQ ID NO: 1298) |
|  | 3'-CAACUAAAAAAGAUAACAAAAAUCUU-5' | (SEQ ID NO: 644) |
| MYC-2323 Target: | 5'-GTTGATTTTTTCTATTGTTTTTAGAA-3' | (SEQ ID NO: 971) |
|  | 5'-GAUUUUUUCUAUUGUUUUUAGAAA-3' | (SEQ ID NO: 1299) |
|  | 3'-AACUAAAAAAGAUAACAAAAAUCUUU-5' | (SEQ ID NO: 645) |
| MYC-2324 Target: | 5'-TTGATTTTTTCTATTGTTTTTAGAAA-3' | (SEQ ID NO: 972) |
|  | 5'-AUUUUUUCUAUUGUUUUUAGAAAA-3' | (SEQ ID NO: 1300) |
|  | 3'-ACUAAAAAAGAUAACAAAAAUCUUUU-5' | (SEQ ID NO: 646) |
| MYC-2325 Target: | 5'-TGATTTTTTCTATTGTTTTTAGAAAA-3' | (SEQ ID NO: 973) |
|  | 5'-UUUUUUCUAUUGUUUUUAGAAAAA-3' | (SEQ ID NO: 1301) |
|  | 3'-CUAAAAAAGAUAACAAAAAUCUUUUU-5' | (SEQ ID NO: 647) |
| MYC-2326 Target: | 5'-GATTTTTTCTATTGTTTTTAGAAAAA-3' | (SEQ ID NO: 974) |
|  | 5'-UUUUUCUAUUGUUUUUAGAAAAAA-3' | (SEQ ID NO: 1302) |
|  | 3'-UAAAAAAGAUAACAAAAAUCUUUUUU-5' | (SEQ ID NO: 648) |
| MYC-2327 Target: | 5'-ATTTTTTCTATTGTTTTTAGAAAAAA-3' | (SEQ ID NO: 975) |
|  | 5'-UUUUUCUAUUGUUUUUAGAAAAAAU-3' | (SEQ ID NO: 1303) |
|  | 3'-AAAAAAGAUAACAAAAAUCUUUUUUA-5' | (SEQ ID NO: 649) |
| MYC-2328 Target: | 5'-TTTTTTTCTATTGTTTTTAGAAAAAAT-3' | (SEQ ID NO: 976) |
|  | 5'-UUUUCUAUUGUUUUUAGAAAAAAUA-3' | (SEQ ID NO: 1304) |
|  | 3'-AAAAAGAUAACAAAAAUCUUUUUUAU-5' | (SEQ ID NO: 650) |
| MYC-2329 Target: | 5'-TTTTTTCTATTGTTTTTAGAAAAAATA-3' | (SEQ ID NO: 977) |
|  | 5'-UUUCUAUUGUUUUUAGAAAAAAUAA-3' | (SEQ ID NO: 1305) |
|  | 3'-AAAAGAUAACAAAAAUCUUUUUUAUU-5' | (SEQ ID NO: 651) |
| MYC-2330 Target: | 5'-TTTTTCTATTGTTTTTAGAAAAAATAA-3' | (SEQ ID NO: 978) |
|  | 5'-UUCUAUUGUUUUUAGAAAAAAUAAA-3' | (SEQ ID NO: 1306) |
|  | 3'-AAAGAUAACAAAAAUCUUUUUUAUUU-5' | (SEQ ID NO: 652) |
| MYC-2331 Target: | 5'-TTTTCTATTGTTTTTAGAAAAAATAAA-3' | (SEQ ID NO: 979) |
|  | 5'-UCUAUUGUUUUUAGAAAAAAUAAAA-3' | (SEQ ID NO: 1307) |
|  | 3'-AAAGAUAACAAAAAUCUUUUUUAUUUU-5' | (SEQ ID NO: 653) |
| MYC-2332 Target: | 5'-TTTCTATTGTTTTTAGAAAAAATAAAA-3' | (SEQ ID NO: 980) |
|  | 5'-CUAUUGUUUUUAGAAAAAAUAAAAU-3' | (SEQ ID NO: 1308) |
|  | 3'-AAGAUAACAAAAAUCUUUUUUAUUUUA-5' | (SEQ ID NO: 654) |
| MYC-2333 Target: | 5'-TTCTATTGTTTTTAGAAAAAATAAAT-3' | (SEQ ID NO: 981) |

TABLE 4

Selected Mouse Anti-MYC DsiRNAs (Asymmetrics)

|  |  |  |
|---|---|---|
|  | 5'-GGAUCCUGAGUCGCAGUAUAAAAga-3' | (SEQ ID NO: 3271) |
|  | 3'-UCCCUAGGACUCAGCGUCAUAUUUCU-5' | (SEQ ID NO: 3415) |
| MYC-m187 Target: | 5'-AGGGATCCTGAGTCGCAGTATAAAGA-3' | (SEQ ID NO: 3559) |
|  | 5'-GAGUCGCAGUAUAAAAGAAGCUUtt-3' | (SEQ ID NO: 3272) |
|  | 3'-GACUCAGCGUCAUAUUUCUUCGAAAA-5' | (SEQ ID NO: 3416) |
| MYC-m194 Target: | 5'-CTGAGTCGCAGTATAAAGAAGCTTTT-3' | (SEQ ID NO: 3560) |
|  | 5'-GCAGUAUAAAAGAAGCUUUUCGGgc-3' | (SEQ ID NO: 3273) |
|  | 3'-AGCGUCAUAUUUCUUCGAAAAGCCCG-5' | (SEQ ID NO: 3417) |
| MYC-m199 Target: | 5'-TCGCAGTATAAAGAAGCTTTTCGGGC-3' | (SEQ ID NO: 3561) |
|  | 5'-GAAGCUUUUCGGGCGUUUUUUCtg-3' | (SEQ ID NO: 3274) |
|  | 3'-UUCUUCGAAAAGCCCGCAAAAAAGAC-5' | (SEQ ID NO: 3418) |
| MYC-m210 Target: | 5'-AAGAAGCTTTTCGGGCGTTTTTTCTG-3' | (SEQ ID NO: 3562) |
|  | 5'-CGUUUUUUCUGACUCGCUGUAGta-3' | (SEQ ID NO: 3275) |
|  | 3'-CCGCAAAAAAGACUGAGCGACAUCAU-5' | (SEQ ID NO: 3419) |
| MYC-m223 Target: | 5'-GGCGTTTTTTCTGACTCGCTGTAGTA-3' | (SEQ ID NO: 3563) |
|  | 5'-AGGGAGUGAGCGGACGGUUGGAAga-3' | (SEQ ID NO: 3276) |
|  | 3'-UCUCCCUCACUCGCCUGCCAACCUUCU-5' | (SEQ ID NO: 3420) |
| MYC-m265 Target: | 5'-AGAGGGAGTGAGCGGACGGTTGGAAGA-3' | (SEQ ID NO: 3564) |
|  | 5'-AGCGGACGGUUGGAAGAGCCGUGtg-3' | (SEQ ID NO: 3277) |
|  | 3'-ACUCGCCUGCCAACCUUCUCGGCACAC-5' | (SEQ ID NO: 3421) |
| MYC-m273 Target: | 5'-TGAGCGGACGGTTGGAAGAGCCGTGTG-3' | (SEQ ID NO: 3565) |
|  | 5'-CCUAAGAAGGCAGCUCUGGAGUGag-3' | (SEQ ID NO: 3278) |
|  | 3'-CUGGAUUCUUCCGUCGAGACCUCACUC-5' | (SEQ ID NO: 3422) |
| MYC-m321 Target: | 5'-GACCTAAGAAGGCAGCTCTGGAGTGAG-3' | (SEQ ID NO: 3566) |
|  | 5'-ACCCUGCGACUGACCCAACAUCAgc-3' | (SEQ ID NO: 3279) |
|  | 3'-GUUGGGACGCUGACUGGGUUGUAGUCG-5' | (SEQ ID NO: 3423) |
| MYC-m384 Target: | 5'-CAACCCTGCGACTGACCCAACATCAGC-3' | (SEQ ID NO: 3567) |
|  | 5'-GCAGACACUUCUCACUGGAACUUac-3' | (SEQ ID NO: 3280) |
|  | 3'-CCCGUCUGUGAAGAGUGACCUUGAAUG-5' | (SEQ ID NO: 3424) |
| MYC-m455 Target: | 5'-GGGCAGACACTTCTCACTGGAACTTAC-3' | (SEQ ID NO: 3568) |
|  | 5'-CACUUCUCACUGGAACUUACAAUct-3' | (SEQ ID NO: 3281) |
|  | 3'-CUGUGAAGAGUGACCUUGAAUGUUAGA-5' | (SEQ ID NO: 3425) |
| MYC-m460 Target: | 5'-GACACTTCTCACTGGAACTTACAATCT-3' | (SEQ ID NO: 3569) |
|  | 5'-CUGGAACUUACAAUCUGCGAGCCag-3' | (SEQ ID NO: 3282) |
|  | 3'-GUGACCUUGAAUGUUAGACGCUCGGUC-5' | (SEQ ID NO: 3426) |
| MYC-m469 Target: | 5'-CACTGGAACTTACAATCTGCGAGCCAG-3' | (SEQ ID NO: 3570) |
|  | 5'-ACAAUCUGCGAGCCAGGACAGGAct-3' | (SEQ ID NO: 3283) |
|  | 3'-AAUGUUAGACGCUCGGUCCUGUCCUGA-5' | (SEQ ID NO: 3427) |
| MYC-m478 Target: | 5'-TTACAATCTGCGAGCCAGGACAGGACT-3' | (SEQ ID NO: 3571) |

TABLE 4-continued

Selected Mouse Anti-MYC DsiRNAs (Asymmetrics)

|  |  |  |
|---|---|---|
|  | 5'-AAGAGCUCCUCGAGCUGUUUGAAgg-3' | (SEQ ID NO: 3284) |
|  | 3'-UUUUCUCGAGGAGCUCGACAAACUUCC-5' | (SEQ ID NO: 3428) |
| MYC-m581 Target: | 5'-AAAAGAGCTCCTCGAGCTGTTTGAAGG-3' | (SEQ ID NO: 3572) |
|  | 5'-CGAGCUGUUUGAAGGCUGGAUUUcc-3' | (SEQ ID NO: 3285) |
|  | 3'-GAGCUCGACAAACUUCCGACCUAAAGG-5' | (SEQ ID NO: 3429) |
| MYC-m591 Target: | 5'-CTCGAGCTGTTTGAAGGCTGGATTTCC-3' | (SEQ ID NO: 3573) |
|  | 5'-GUUUGAAGGCUGGAUUUCCUUUGgg-3' | (SEQ ID NO: 3286) |
|  | 3'-GACAAACUUCCGACCUAAAGGAAACCC-5' | (SEQ ID NO: 3430) |
| MYC-m597 Target: | 5'-CTGTTTGAAGGCTGGATTTCCTTTGGG-3' | (SEQ ID NO: 3574) |
|  | 5'-GAUUUCCUUUGGGCGUUGGAAACcc-3' | (SEQ ID NO: 3287) |
|  | 3'-ACCUAAAGGAAACCCGCAACCUUUGGG-5' | (SEQ ID NO: 3431) |
| MYC-m609 Target: | 5'-TGGATTTCCTTTGGGCGTTGGAAACCC-3' | (SEQ ID NO: 3575) |
|  | 5'-CUCAACGUGAACUUCACCAACAGga-3' | (SEQ ID NO: 3288) |
|  | 3'-GGGAGUUGCACUUGAAGUGGUUGUCCU-5' | (SEQ ID NO: 3432) |
| MYC-m657 Target: | 5'-CCCTCAACGTGAACTTCACCAACAGGA-3' | (SEQ ID NO: 3576) |
|  | 5'-GUGAACUUCACCAACAGGAACUAtg-3' | (SEQ ID NO: 3289) |
|  | 3'-UGCACUUGAAGUGGUUGUCCUUGAUAC-5' | (SEQ ID NO: 3433) |
| MYC-m663 Target: | 5'-ACGTGAACTTCACCAACAGGAACTATG-3' | (SEQ ID NO: 3577) |
|  | 5'-GACUCCGUACAGCCCUAUUUCAUct-3' | (SEQ ID NO: 3290) |
|  | 3'-UGCUGAGGCAUGUCGGGAUAAAGUAGA-5' | (SEQ ID NO: 3434) |
| MYC-m699 Target: | 5'-ACGACTCCGTACAGCCCTATTTCATCT-3' | (SEQ ID NO: 3578) |
|  | 5'-GCGACGAGGAAGAGAAUUUCUAUca-3' | (SEQ ID NO: 3291) |
|  | 3'-GACGCUGCUCCUUCUCUUAAAGAUAGU-5' | (SEQ ID NO: 3435) |
| MYC-m724 Target: | 5'-CTGCGACGAGGAAGAGAATTTCTATCA-3' | (SEQ ID NO: 3579) |
|  | 5'-GAAGAGAAUUUCUAUCACCAGCAac-3' | (SEQ ID NO: 3292) |
|  | 3'-UCCUUCUCUUAAAGAUAGUGGUCGUUG-5' | (SEQ ID NO: 3436) |
| MYC-m732 Target: | 5'-AGGAAGAGAATTTCTATCACCAGCAAC-3' | (SEQ ID NO: 3580) |
|  | 5'-GUGAGGAUAUCUGGAAGAAAUUCga-3' | (SEQ ID NO: 3293) |
|  | 3'-GUCACUCCUAUAGACCUUCUUUAAGCU-5' | (SEQ ID NO: 3437) |
| MYC-m787 Target: | 5'-CAGTGAGGATATCTGGAAGAAATTCGA-3' | (SEQ ID NO: 3581) |
|  | 5'-GAAGAAAUUCGAGCUGCUUCCCAcc-3' | (SEQ ID NO: 3294) |
|  | 3'-ACCUUCUUUAAGCUCGACGAAGGGUGG-5' | (SEQ ID NO: 3438) |
| MYC-m800 Target: | 5'-TGGAAGAAATTCGAGCTGCTTCCCACC-3' | (SEQ ID NO: 3582) |
|  | 5'-GGGCUCUGCUCUCCAUCCUAUGUtg-3' | (SEQ ID NO: 3295) |
|  | 3'-GGCCCGAGACGAGAGGUAGGAUACAAC-5' | (SEQ ID NO: 3439) |
| MYC-m852 Target: | 5'-CCGGGCTCTGCTCTCCATCCTATGTTG-3' | (SEQ ID NO: 3583) |
|  | 5'-CUGCUCUCCAUCCUAUGUUGCGGtc-3' | (SEQ ID NO: 3296) |
|  | 3'-GAGACGAGAGGUAGGAUACAACGCCAG-5' | (SEQ ID NO: 3440) |
| MYC-m857 Target: | 5'-CTCTGCTCTCCATCCTATGTTGCGGTC-3' | (SEQ ID NO: 3584) |

TABLE 4-continued

Selected Mouse Anti-MYC DsiRNAs (Asymmetrics)

|  |  |  |
|---|---|---|
|  | 5'-UCCUAUGUUGCGGUCGCUACGUCct-3' | (SEQ ID NO: 3297) |
|  | 3'-<u>GUA</u>GGAUACAACGCCAGCGAUGCAG<u>GA</u>-5' | (SEQ ID NO: 3441) |
| MYC-m867 Target: | 5'-CATCCTATGTTGCGGTCGCTACGTCCT-3' | (SEQ ID NO: 3585) |
|  | 5'-GUUGCGGUCGCUACGUCCUUCUCcc-3' | (SEQ ID NO: 3298) |
|  | 3'-<u>UAC</u>AACGCCAGCGAUGCAGGAAGAG<u>GG</u>-5' | (SEQ ID NO: 3442) |
| MYC-m873 Target: | 5'-ATGTTGCGGTCGCTACGTCCTTCTCCC-3' | (SEQ ID NO: 3586) |
|  | 5'-CCGAUCAGCUGGAGAUGAUGACCga-3' | (SEQ ID NO: 3299) |
|  | 3'-<u>GCG</u>GCUAGUCGACCUCUACUACUGG<u>CU</u>-5' | (SEQ ID NO: 3443) |
| MYC-m940 Target: | 5'-CGCCGATCAGCTGGAGATGATGACCGA-3' | (SEQ ID NO: 3587) |
|  | 5'-CUGGAGAUGAUGACCGAGUUACUtg-3' | (SEQ ID NO: 3300) |
|  | 3'-<u>UCG</u>ACCUCUACUACUGGCUCAAUGA<u>AC</u>-5' | (SEQ ID NO: 3444) |
| MYC-m948 Target: | 5'-AGCTGGAGATGATGACCGAGTTACTTG-3' | (SEQ ID NO: 3588) |
|  | 5'-GAUGACCGAGUUACUUGGAGGAGac-3' | (SEQ ID NO: 3301) |
|  | 3'-<u>UAC</u>UACUGGCUCAAUGAACCUCCUC<u>UG</u>-5' | (SEQ ID NO: 3445) |
| MYC-m956 Target: | 5'-ATGATGACCGAGTTACTTGGAGGAGAC-3' | (SEQ ID NO: 3589) |
|  | 5'-AGUUACUUGGAGGAGACAUGGUGaa-3' | (SEQ ID NO: 3302) |
|  | 3'-<u>GCU</u>CAAUGAACCUCCUCUGUACCAC<u>UU</u>-5' | (SEQ ID NO: 3446) |
| MYC-m964 Target: | 5'-CGAGTTACTTGGAGGAGACATGGTGAA-3' | (SEQ ID NO: 3590) |
|  | 5'-CUUGGAGGAGACAUGGUGAACCAga-3' | (SEQ ID NO: 3303) |
|  | 3'-<u>AUG</u>AACCUCCUCUGUACCACUUGGU<u>CU</u>-5' | (SEQ ID NO: 3447) |
| MYC-m969 Target: | 5'-TACTTGGAGGAGACATGGTGAACCAGA-3' | (SEQ ID NO: 3591) |
|  | 5'-CAUGGUGAACCAGAGCUUCAUCUgc-3' | (SEQ ID NO: 3304) |
|  | 3'-<u>CUG</u>UACCACUUGGUCUCGAAGUAGA<u>CG</u>-5' | (SEQ ID NO: 3448) |
| MYC-m980 Target: | 5'-GACATGGTGAACCAGAGCTTCATCTGC-3' | (SEQ ID NO: 3592) |
|  | 5'-CCAGAGCUUCAUCUGCGAUCCUGac-3' | (SEQ ID NO: 3305) |
|  | 3'-<u>UUG</u>GUCUCGAAGUAGACGCUAGGAC<u>UG</u>-5' | (SEQ ID NO: 3449) |
| MYC-m989 Target: | 5'-AACCAGAGCTTCATCTGCGATCCTGAC-3' | (SEQ ID NO: 3593) |
|  | 5'-GCUUCAUCUGCGAUCCUGACGACga-3' | (SEQ ID NO: 3306) |
|  | 3'-<u>CUC</u>GAAGUAGACGCUAGGACUGCUG<u>CU</u>-5' | (SEQ ID NO: 3450) |
| MYC-m994 Target: | 5'-GAGCTTCATCTGCGATCCTGACGACGA-3' | (SEQ ID NO: 3594) |
|  | 5'-UCUGCGAUCCUGACGACGAGACCtt-3' | (SEQ ID NO: 3307) |
|  | 3'-<u>GUA</u>GACGCUAGGACUGCUGCUCUGG<u>AA</u>-5' | (SEQ ID NO: 3451) |
| MYC-m1000 Target: | 5'-CATCTGCGATCCTGACGACGAGACCTT-3' | (SEQ ID NO: 3595) |
|  | 5'-AUCCUGACGACGAGACCUUCAUCaa-3' | (SEQ ID NO: 3308) |
|  | 3'-<u>GCU</u>AGGACUGCUGCUCUGGAAGUAG<u>UU</u>-5' | (SEQ ID NO: 3452) |
| MYC-m1006 Target: | 5'-CGATCCTGACGACGAGACCTTCATCAA-3' | (SEQ ID NO: 3596) |
|  | 5'-GACGAGACCUUCAUCAAGAACAUca-3' | (SEQ ID NO: 3309) |
|  | 3'-<u>UGC</u>UGCUCUGGAAGUAGUUCUUGUA<u>GU</u>-5' | (SEQ ID NO: 3453) |
| MYC-m1014 Target: | 5'-ACGACGAGACCTTCATCAAGAACATCA-3' | (SEQ ID NO: 3597) |

TABLE 4-continued

Selected Mouse Anti-MYC DsiRNAs (Asymmetrics)

|  |  |  |  |
|---|---|---|---|
|  | 5'-ACCUUCAUCAAGAACAUCAUCAUcc-3' | (SEQ ID NO: 3310) |
|  | 3'-UCUGGAAGUAGUUCUUGUAGUAGUAGG-5' | (SEQ ID NO: 3454) |
| MYC-m1020 Target: | 5'-AGACCTTCATCAAGAACATCATCATCC-3' | (SEQ ID NO: 3598) |
|  | 5'-AAGAACAUCAUCAUCCAGGACUGta-3' | (SEQ ID NO: 3311) |
|  | 3'-AGUUCUUGUAGUAGUAGGUCCUGACAU-5' | (SEQ ID NO: 3455) |
| MYC-m1029 Target: | 5'-TCAAGAACATCATCATCCAGGACTGTA-3' | (SEQ ID NO: 3599) |
|  | 5'-GGACUGUAUGUGGAGCGGUUUCUca-3' | (SEQ ID NO: 3312) |
|  | 3'-GUCCUGACAUACACCUCGCCAAAGAGU-5' | (SEQ ID NO: 3456) |
| MYC-m1046 Target: | 5'-CAGGACTGTATGTGGAGCGGTTTCTCA-3' | (SEQ ID NO: 3600) |
|  | 5'-UGCUCCACCUCCAGCCUGUACCUgc-3' | (SEQ ID NO: 3313) |
|  | 3'-AGACGAGGUGGAGGUCGGACAUGGACG-5' | (SEQ ID NO: 3457) |
| MYC-m1164 Target: | 5'-TCTGCTCCACCTCCAGCCTGTACCTGC-3' | (SEQ ID NO: 3601) |
|  | 5'-ACCUCCAGCCUGUACCUGCAGGAcc-3' | (SEQ ID NO: 3314) |
|  | 3'-GGUGGAGGUCGGACAUGGACGUCCUGG-5' | (SEQ ID NO: 3458) |
| MYC-m1170 Target: | 5'-CCACCTCCAGCCTGTACCTGCAGGACC-3' | (SEQ ID NO: 3602) |
|  | 5'-AGCCUGUACCUGCAGGACCUCACcg-3' | (SEQ ID NO: 3315) |
|  | 3'-GGUCGGACAUGGACGUCCUGGAGUGGC-5' | (SEQ ID NO: 3459) |
| MYC-m1176 Target: | 5'-CCAGCCTGTACCTGCAGGACCTCACCG-3' | (SEQ ID NO: 3603) |
|  | 5'-GCAGCUCGCCCAAAUCCUGUACCtc-3' | (SEQ ID NO: 3316) |
|  | 3'-GUCGUCGAGCGGGUUUAGGACAUGGAG-5' | (SEQ ID NO: 3460) |
| MYC-m1258 Target: | 5'-CAGCAGCTCGCCCAAATCCTGTACCTC-3' | (SEQ ID NO: 3604) |
|  | 5'-AAAUCCUGUACCUCGUCCGAUUCca-3' | (SEQ ID NO: 3317) |
|  | 3'-GGUUUAGGACAUGGAGCAGGCUAAGGU-5' | (SEQ ID NO: 3461) |
| MYC-m1269 Target: | 5'-CCAAATCCTGTACCTCGTCCGATTCCA-3' | (SEQ ID NO: 3605) |
|  | 5'-CACCAGCAGCGACUCUGAAGAAGag-3' | (SEQ ID NO: 3318) |
|  | 3'-UGGUGGUCGUCGCUGAGACUUCUUCUC-5' | (SEQ ID NO: 3462) |
| MYC-m1391 Target: | 5'-ACCACCAGCAGCGACTCTGAAGAAGAG-3' | (SEQ ID NO: 3606) |
|  | 5'-GCAGCGACUCUGAAGAAGAGCAAga-3' | (SEQ ID NO: 3319) |
|  | 3'-GUCGUCGCUGAGACUUCUUCUCGUUCU-5' | (SEQ ID NO: 3463) |
| MYC-m1396 Target: | 5'-CAGCAGCGACTCTGAAGAAGAGCAAGA-3' | (SEQ ID NO: 3607) |
|  | 5'-ACUCUGAAGAAGAGCAAGAAGAUga-3' | (SEQ ID NO: 3320) |
|  | 3'-GCUGAGACUUCUUCUCGUUCUUCUACU-5' | (SEQ ID NO: 3464) |
| MYC-m1402 Target: | 5'-CGACTCTGAAGAAGAGCAAGAAGATGA-3' | (SEQ ID NO: 3608) |
|  | 5'-GAAGAAGAGCAAGAAGAUGAGGAag-3' | (SEQ ID NO: 3321) |
|  | 3'-GACUUCUUCUCGUUCUUCUACUCCUUC-5' | (SEQ ID NO: 3465) |
| MYC-m1407 Target: | 5'-CTGAAGAAGAGCAAGAAGATGAGGAAG-3' | (SEQ ID NO: 3609) |
|  | 5'-AGCAAGAAGAUGAGGAAGAAAUUga-3' | (SEQ ID NO: 3322) |
|  | 3'-UCUCGUUCUUCUACUCCUUCUUUAACU-5' | (SEQ ID NO: 3466) |
| MYC-m1414 Target: | 5'-AGAGCAAGAAGATGAGGAAGAAATTGA-3' | (SEQ ID NO: 3610) |

TABLE 4-continued

Selected Mouse Anti-MYC DsiRNAs (Asymmetrics)

|  |  |  |  |
|---|---|---|---|
|  | 5'-AAGAUGAGGAAGAAAUUGAUGUGgt-3' | (SEQ ID NO: 3323) |  |
|  | 3'-UCUUCUACUCCUUCUUUAACUACACCA-5' | (SEQ ID NO: 3467) |  |
| MYC-m1420 Target: | 5'-AGAAGATGAGGAAGAAATTGATGTGGT-3' | (SEQ ID NO: 3611) |  |
|  | 5'-AGGAAGAAAUUGAUGUGGUGUCUgt-3' | (SEQ ID NO: 3324) |  |
|  | 3'-ACUCCUUCUUUAACUACACCACAGACA-5' | (SEQ ID NO: 3468) |  |
| MYC-m1426 Target: | 5'-TGAGGAAGAAATTGATGTGGTGTCTGT-3' | (SEQ ID NO: 3612) |  |
|  | 5'-GAAAUUGAUGUGGUGUCUGUGGAga-3' | (SEQ ID NO: 3325) |  |
|  | 3'-UUCUUUAACUACACCACAGACACCUCU-5' | (SEQ ID NO: 3469) |  |
| MYC-m1431 Target: | 5'-AAGAAATTGATGTGGTGTCTGTGGAGA-3' | (SEQ ID NO: 3613) |  |
|  | 5'-GAUGUGGUGUCUGUGGAGAAGAGgc-3' | (SEQ ID NO: 3326) |  |
|  | 3'-AACUACACCACAGACACCUCUUCUCCG-5' | (SEQ ID NO: 3470) |  |
| MYC-m1437 Target: | 5'-TTGATGTGGTGTCTGTGGAGAAGAGGC-3' | (SEQ ID NO: 3614) |  |
|  | 5'-GUGUCUGUGGAGAAGAGGCAAACcc-3' | (SEQ ID NO: 3327) |  |
|  | 3'-ACCACAGACACCUCUUCUCCGUUUGGG-5' | (SEQ ID NO: 3471) |  |
| MYC-m1443 Target: | 5'-TGGTGTCTGTGGAGAAGAGGCAAACCC-3' | (SEQ ID NO: 3615) |  |
|  | 5'-GCCAAGAGGUCGGAGUCGGGCUCat-3' | (SEQ ID NO: 3328) |  |
|  | 3'-GACGGUUCUCCAGCCUCAGCCCGAGUA-5' | (SEQ ID NO: 3472) |  |
| MYC-m1470 Target: | 5'-CTGCCAAGAGGTCGGAGTCGGGCTCAT-3' | (SEQ ID NO: 3616) |  |
|  | 5'-CAAGAGGUGCCACGUCUCCACUCac-3' | (SEQ ID NO: 3329) |  |
|  | 3'-GAGUUCUCCACGGUGCAGAGGUGAGUG-5' | (SEQ ID NO: 3473) |  |
| MYC-m1541 Target: | 5'-CTCAAGAGGTGCCACGTCTCCACTCAC-3' | (SEQ ID NO: 3617) |  |
|  | 5'-GUCUCCACUCACCAGCACAACUAcg-3' | (SEQ ID NO: 3330) |  |
|  | 3'-UGCAGAGGUGAGUGGUCGUGUUGAUGC-5' | (SEQ ID NO: 3474) |  |
| MYC-m1554 Target: | 5'-ACGTCTCCACTCACCAGCACAACTACG-3' | (SEQ ID NO: 3618) |  |
|  | 5'-GCCAAGAGGGCCAAGUUGGACAGtg-3' | (SEQ ID NO: 3331) |  |
|  | 3'-GACGGUUCUCCCGGUUCAACCUGUCAC-5' | (SEQ ID NO: 3475) |  |
| MYC-m1614 Target: | 5'-CTGCCAAGAGGGCCAAGTTGGACAGTG-3' | (SEQ ID NO: 3619) |  |
|  | 5'-GAGGGCCAAGUUGGACAGUGGCAgg-3' | (SEQ ID NO: 3332) |  |
|  | 3'-UUCUCCCGGUUCAACCUGUCACCGUCC-5' | (SEQ ID NO: 3476) |  |
| MYC-m1619 Target: | 5'-AAGAGGGCCAAGTTGGACAGTGGCAGG-3' | (SEQ ID NO: 3620) |  |
|  | 5'-AGUUGGACAGUGGCAGGGUCCUGaa-3' | (SEQ ID NO: 3333) |  |
|  | 3'-GUUCAACCUGUCACCGUCCCAGGACUU-5' | (SEQ ID NO: 3477) |  |
| MYC-m1627 Target: | 5'-CAAGTTGGACAGTGGCAGGGTCCTGAA-3' | (SEQ ID NO: 3621) |  |
|  | 5'-GACAGUGGCAGGGUCCUGAAGCAga-3' | (SEQ ID NO: 3334) |  |
|  | 3'-ACCUGUCACCGUCCCAGGACUUCGUCU-5' | (SEQ ID NO: 3478) |  |
| MYC-m1632 Target: | 5'-TGGACAGTGGCAGGGTCCTGAAGCAGA-3' | (SEQ ID NO: 3622) |  |
|  | 5'-GGCAGGGUCCUGAAGCAGAUCAGca-3' | (SEQ ID NO: 3335) |  |
|  | 3'-CACCGUCCCAGGACUUCGUCUAGUCGU-5' | (SEQ ID NO: 3479) |  |
| MYC-m1638 Target: | 5'-GTGGCAGGGTCCTGAAGCAGATCAGCA-3' | (SEQ ID NO: 3623) |  |

TABLE 4-continued

Selected Mouse Anti-MYC DsiRNAs (Asymmetrics)

|  |  |  |
|---|---|---|
|  | 5'-GUCCUGAAGCAGAUCAGCAACAAcc-3' | (SEQ ID NO: 3336) |
|  | 3'-CCCAGGACUUCGUCUAGUCGUUGUUGG-5' | (SEQ ID NO: 3480) |
| MYC-m1644 Target: | 5'-GGGTCCTGAAGCAGATCAGCAACAACC-3' | (SEQ ID NO: 3624) |
|  | 5'-GAAGCAGAUCAGCAACAACCGCAag-3' | (SEQ ID NO: 3337) |
|  | 3'-GACUUCGUCUAGUCGUUGUUGGCGUUC-5' | (SEQ ID NO: 3481) |
| MYC-m1649 Target: | 5'-CTGAAGCAGATCAGCAACAACCGCAAG-3' | (SEQ ID NO: 3625) |
|  | 5'-CGAGCUGAAGCGCAGCUUUUUUGcc-3' | (SEQ ID NO: 3338) |
|  | 3'-UUGCUCGACUUCGCGUCGAAAAAACGG-5' | (SEQ ID NO: 3482) |
| MYC-m1754 Target: | 5'-AACGAGCTGAAGCGCAGCTTTTTTGCC-3' | (SEQ ID NO: 3626) |
|  | 5'-GCAGCUUUUUUGCCCUGCGUGACca-3' | (SEQ ID NO: 3339) |
|  | 3'-CGCGUCGAAAAAACGGGACGCACUGGU-5' | (SEQ ID NO: 3483) |
| MYC-m1765 Target: | 5'-GCGCAGCTTTTTTGCCCTGCGTGACCA-3' | (SEQ ID NO: 3627) |
|  | 5'-CCUGCGUGACCAGAUCCCUGAAUtg-3' | (SEQ ID NO: 3340) |
|  | 3'-CGGGACGCACUGGUCUAGGGACUUAAC-5' | (SEQ ID NO: 3484) |
| MYC-m1778 Target: | 5'-GCCCTGCGTGACCAGATCCCTGAATTG-3' | (SEQ ID NO: 3628) |
|  | 5'-ACCAGAUCCCUGAAUUGGAAAACaa-3' | (SEQ ID NO: 3341) |
|  | 3'-ACUGGUCUAGGGACUUAACCUUUUGUU-5' | (SEQ ID NO: 3485) |
| MYC-m1786 Target: | 5'-TGACCAGATCCCTGAATTGGAAAACAA-3' | (SEQ ID NO: 3629) |
|  | 5'-CUGAAUUGGAAAACAACGAAAAGgc-3' | (SEQ ID NO: 3342) |
|  | 3'-GGGACUUAACCUUUUGUUGCUUUUCCG-5' | (SEQ ID NO: 3486) |
| MYC-m1795 Target: | 5'-CCCTGAATTGGAAAACAACGAAAAGGC-3' | (SEQ ID NO: 3630) |
|  | 5'-AGGUAGUGAUCCUCAAAAAAGCCac-3' | (SEQ ID NO: 3343) |
|  | 3'-GUUCCAUCACUAGGAGUUUUUUCGGUG-5' | (SEQ ID NO: 3487) |
| MYC-m1825 Target: | 5'-CAAGGTAGTGATCCTCAAAAAAGCCAC-3' | (SEQ ID NO: 3631) |
|  | 5'-CAAAAAAGCCACCGCCUACAUCCtg-3' | (SEQ ID NO: 3344) |
|  | 3'-GAGUUUUUUCGGUGGCGGAUGUAGGAC-5' | (SEQ ID NO: 3488) |
| MYC-m1838 Target: | 5'-CTCAAAAAAGCCACCGCCTACATCCTG-3' | (SEQ ID NO: 3632) |
|  | 5'-GCCACCGCCUACAUCCUGUCCAUtc-3' | (SEQ ID NO: 3345) |
|  | 3'-UUCGGUGGCGGAUGUAGGACAGGUAAG-5' | (SEQ ID NO: 3489) |
| MYC-m1845 Target: | 5'-AAGCCACCGCCTACATCCTGTCCATTC-3' | (SEQ ID NO: 3633) |
|  | 5'-CGCCUACAUCCUGUCCAUUCAAGca-3' | (SEQ ID NO: 3346) |
|  | 3'-UGGCGGAUGUAGGACAGGUAAGUUCGU-5' | (SEQ ID NO: 3490) |
| MYC-m1850 Target: | 5'-ACCGCCTACATCCTGTCCATTCAAGCA-3' | (SEQ ID NO: 3634) |
|  | 5'-ACAUCCUGUCCAUUCAAGCAGACga-3' | (SEQ ID NO: 3347) |
|  | 3'-GAUGUAGGACAGGUAAGUUCGUCUGCU-5' | (SEQ ID NO: 3491) |
| MYC-m1855 Target: | 5'-CTACATCCTGTCCATTCAAGCAGACGA-3' | (SEQ ID NO: 3635) |
|  | 5'-CUGUCCAUUCAAGCAGACGAGCAca-3' | (SEQ ID NO: 3348) |
|  | 3'-AGGACAGGUAAGUUCGUCUGCUCGUGU-5' | (SEQ ID NO: 3492) |
| MYC-m1860 Target: | 5'-TCCTGTCCATTCAAGCAGACGAGCACA-3' | (SEQ ID NO: 3636) |

TABLE 4-continued

Selected Mouse Anti-MYC DsiRNAs (Asymmetrics)

|  |  |  |
|---|---|---|
|  | 5'-CAGACGAGCACAAGCUCACCUCUga-3' | (SEQ ID NO: 3349) |
|  | 3'-UCGUCUGCUCGUGUUCGAGUGGAGACU-5' | (SEQ ID NO: 3493) |
| MYC-m1873 Target: | 5'-AGCAGACGAGCACAAGCTCACCTCTGA-3' | (SEQ ID NO: 3637) |
|  | 5'-AGCACAAGCUCACCUCUGAAAAGga-3' | (SEQ ID NO: 3350) |
|  | 3'-GCUCGUGUUCGAGUGGAGACUUUUCCU-5' | (SEQ ID NO: 3494) |
| MYC-m1879 Target: | 5'-CGAGCACAAGCTCACCTCTGAAAGGA-3' | (SEQ ID NO: 3638) |
|  | 5'-CUCACCUCUGAAAAGGACUUAUUga-3' | (SEQ ID NO: 3351) |
|  | 3'-UCGAGUGGAGACUUUUCCUGAAUAACU-5' | (SEQ ID NO: 3495) |
| MYC-m1887 Target: | 5'-AGCTCACCTCTGAAAAGGACTTATTGA-3' | (SEQ ID NO: 3639) |
|  | 5'-GAAAAGGACUUAUUGAGGAAACGac-3' | (SEQ ID NO: 3352) |
|  | 3'-GACUUUUCCUGAAUAACUCCUUUGCUG-5' | (SEQ ID NO: 3496) |
| MYC-m1896 Target: | 5'-CTGAAAAGGACTTATTGAGGAAACGAC-3' | (SEQ ID NO: 3640) |
|  | 5'-GAGGAAACGACGAGAACAGUUGAaa-3' | (SEQ ID NO: 3353) |
|  | 3'-AACUCCUUUGCUGCUCUUGUCAACUUU-5' | (SEQ ID NO: 3497) |
| MYC-m1910 Target: | 5'-TTGAGGAAACGACGAGAACAGTTGAAA-3' | (SEQ ID NO: 3641) |
|  | 5'-AAACUCGAACAGCUUCGAAACUCtg-3' | (SEQ ID NO: 3354) |
|  | 3'-UGUUUGAGCUUGUCGAAGCUUUGAGAC-5' | (SEQ ID NO: 3498) |
| MYC-m1938 Target: | 5'-ACAAACTCGAACAGCTTCGAAACTCTG-3' | (SEQ ID NO: 3642) |
|  | 5'-CGAACAGCUUCGAAACUCGGUGca-3' | (SEQ ID NO: 3355) |
|  | 3'-GAGCUUGUCGAAGCUUUGAGACCACGU-5' | (SEQ ID NO: 3499) |
| MYC-m1943 Target: | 5'-CTCGAACAGCTTCGAAACTCTGGTGCA-3' | (SEQ ID NO: 3643) |
|  | 5'-UUCGAAACUCGGUGCAUAAACUga-3' | (SEQ ID NO: 3356) |
|  | 3'-CGAAGCUUUGAGACCACGUAUUUGACU-5' | (SEQ ID NO: 3500) |
| MYC-m1951 Target: | 5'-GCTTCGAAACTCTGGTGCATAAACTGA-3' | (SEQ ID NO: 3644) |
|  | 5'-ACUCUGGUGCAUAAACUGACCUAac-3' | (SEQ ID NO: 3357) |
|  | 3'-UUUGAGACCACGUAUUUGACUGGAUUG-5' | (SEQ ID NO: 3501) |
| MYC-m1957 Target: | 5'-AAACTCTGGTGCATAAACTGACCTAAC-3' | (SEQ ID NO: 3645) |
|  | 5'-GUGCAUAAACUGACCUAACUCGAgg-3' | (SEQ ID NO: 3358) |
|  | 3'-ACCACGUAUUUGACUGGAUUGAGCUCC-5' | (SEQ ID NO: 3502) |
| MYC-m1963 Target: | 5'-TGGTGCATAAACTGACCTAACTCGAGG-3' | (SEQ ID NO: 3646) |
|  | 5'-AGGAGGAGCUGGAAUCUCUCGUGag-3' | (SEQ ID NO: 3359) |
|  | 3'-GCUCCUCCUCGACCUUAGAGAGCACUC-5' | (SEQ ID NO: 3503) |
| MYC-m1985 Target: | 5'-CGAGGAGGAGCTGGAATCTCTCGTGAG-3' | (SEQ ID NO: 3647) |
|  | 5'-GGAAUCUCUCGUGAGAGUAAGGAga-3' | (SEQ ID NO: 3360) |
|  | 3'-GACCUUAGAGAGCACUCUCAUUCCUCU-5' | (SEQ ID NO: 3504) |
| MYC-m1995 Target: | 5'-CTGGAATCTCTCGTGAGAGTAAGGAGA-3' | (SEQ ID NO: 3648) |
|  | 5'-CUCGUGAGAGUAAGGAGAACGGUtc-3' | (SEQ ID NO: 3361) |
|  | 3'-GAGAGCACUCUCAUUCCUCUUGCCAAG-5' | (SEQ ID NO: 3505) |
| MYC-m2002 Target: | 5'-CTCTCGTGAGAGTAAGGAGAACGGTTC-3' | (SEQ ID NO: 3649) |

TABLE 4-continued

Selected Mouse Anti-MYC DsiRNAs (Asymmetrics)

|  |  |  |
|---|---|---|
|  | 5'-GUAAGGAGAACGGUUCCUUCUGAca-3' | (SEQ ID NO: 3362) |
|  | 3'-<u>CUC</u>AUUCCUCUUGCCAAGGAAGACU<u>GU</u>-5' | (SEQ ID NO: 3506) |
| MYC-m2011 Target: | 5'-GAGTAAGGAGAACGGTTCCTTCTGACA-3' | (SEQ ID NO: 3650) |
|  | 5'-GAGAACGGUUCCUUCUGACAGAAct-3' | (SEQ ID NO: 3363) |
|  | 3'-<u>UCC</u>UCUUGCCAAGGAAGACUGUCUU<u>GA</u>-5' | (SEQ ID NO: 3507) |
| MYC-m2016 Target: | 5'-AGGAGAACGGTTCCTTCTGACAGAACT-3' | (SEQ ID NO: 3651) |
|  | 5'-CGGUUCCUUCUGACAGAACUGAUgc-3' | (SEQ ID NO: 3364) |
|  | 3'-<u>UUG</u>CCAAGGAAGACUGUCUUGACUA<u>CG</u>-5' | (SEQ ID NO: 3508) |
| MYC-m2021 Target: | 5'-AACGGTTCCTTCTGACAGAACTGATGC-3' | (SEQ ID NO: 3652) |
|  | 5'-CAGAACUGAUGCGCUGGAAUUAAaa-3' | (SEQ ID NO: 3365) |
|  | 3'-<u>CUG</u>UCUUGACUACGCGACCUUAAUU<u>UU</u>-5' | (SEQ ID NO: 3509) |
| MYC-m2034 Target: | 5'-GACAGAACTGATGCGCTGGAATTAAAA-3' | (SEQ ID NO: 3653) |
|  | 5'-CUGAUGCGCUGGAAUUAAAAUGCat-3' | (SEQ ID NO: 3366) |
|  | 3'-<u>UUG</u>ACUACGCGACCUUAAUUUUACG<u>UA</u>-5' | (SEQ ID NO: 3510) |
| MYC-m2039 Target: | 5'-AACTGATGCGCTGGAATTAAAATGCAT-3' | (SEQ ID NO: 3654) |
|  | 5'-GCGCUGGAAUUAAAAUGCAUGCUca-3' | (SEQ ID NO: 3367) |
|  | 3'-<u>UAC</u>GCGACCUUAAUUUUACGUACGA<u>GU</u>-5' | (SEQ ID NO: 3511) |
| MYC-m2044 Target: | 5'-ATGCGCTGGAATTAAAATGCATGCTCA-3' | (SEQ ID NO: 3655) |
|  | 5'-GGAAUUAAAAUGCAUGCUCAAAGcc-3' | (SEQ ID NO: 3368) |
|  | 3'-<u>GAC</u>CUUAAUUUUACGUACGAGUUUC<u>GG</u>-5' | (SEQ ID NO: 3512) |
| MYC-m2049 Target: | 5'-CTGGAATTAAAATGCATGCTCAAAGCC-3' | (SEQ ID NO: 3656) |
|  | 5'-AAAUGCAUGCUCAAAGCCUAACCtc-3' | (SEQ ID NO: 3369) |
|  | 3'-<u>AUU</u>UUACGUACGAGUUUCGGAUUGG<u>AG</u>-5' | (SEQ ID NO: 3513) |
| MYC-m2056 Target: | 5'-TAAAATGCATGCTCAAAGCCTAACCTC-3' | (SEQ ID NO: 3657) |
|  | 5'-GCUCAAAGCCUAACCUCACAACCtt-3' | (SEQ ID NO: 3370) |
|  | 3'-<u>UAC</u>GAGUUUCGGAUUGGAGUGUUGG<u>AA</u>-5' | (SEQ ID NO: 3514) |
| MYC-m2064 Target: | 5'-ATGCTCAAAGCCTAACCTCACAACCTT-3' | (SEQ ID NO: 3658) |
|  | 5'-AAGCCUAACCUCACAACCUUGGCtg-3' | (SEQ ID NO: 3371) |
|  | 3'-<u>GUU</u>UCGGAUUGGAGUGUUGGAACC<u>GAC</u>-5' | (SEQ ID NO: 3515) |
| MYC-m2069 Target: | 5'-CAAAGCCTAACCTCACAACCTTGGCTG-3' | (SEQ ID NO: 3659) |
|  | 5'-GCUUUGGGACUGUAAGCUUCAGCca-3' | (SEQ ID NO: 3372) |
|  | 3'-<u>CCC</u>GAAACCCUGACAUUCGAAGUCG<u>GU</u>-5' | (SEQ ID NO: 3516) |
| MYC-m2096 Target: | 5'-GGGCTTTGGGACTGTAAGCTTCAGCCA-3' | (SEQ ID NO: 3660) |
|  | 5'-GACUGUAAGCUUCAGCCAUAAUUtt-3' | (SEQ ID NO: 3373) |
|  | 3'-<u>CCC</u>UGACAUUCGAAGUCGGUAUUA<u>AAA</u>-5' | (SEQ ID NO: 3517) |
| MYC-m2103 Target: | 5'-GGGACTGTAAGCTTCAGCCATAATTTT-3' | (SEQ ID NO: 3661) |
|  | 5'-AGCUUCAGCCAUAAUUUUAACUGcc-3' | (SEQ ID NO: 3374) |
|  | 3'-<u>AUU</u>CGAAGUCGGUAUUAAAAUUGAC<u>GG</u>-5' | (SEQ ID NO: 3518) |
| MYC-m2110 Target: | 5'-TAAGCTTCAGCCATAATTTTAACTGCC-3' | (SEQ ID NO: 3662) |

TABLE 4-continued

Selected Mouse Anti-MYC DsiRNAs (Asymmetrics)

|  |  |  |  |
|---|---|---|---|
|  | 5'-GCCAUAAUUUUAACUGCCUCAAAct-3' | (SEQ ID NO: 3375) |
|  | 3'-GUCGGUAUUAAAAUUGACGGAGUUUGA-5' | (SEQ ID NO: 3519) |
| MYC-m2117 Target: | 5'-CAGCCATAATTTTAACTGCCTCAAACT-3' | (SEQ ID NO: 3663) |
|  | 5'-UUUAACUGCCUCAAACUUAAAUAgt-3' | (SEQ ID NO: 3376) |
|  | 3'-UAAAAUUGACGGAGUUUGAAUUUAUCA-5' | (SEQ ID NO: 3520) |
| MYC-m2125 Target: | 5'-ATTTTAACTGCCTCAAACTTAAATAGT-3' | (SEQ ID NO: 3664) |
|  | 5'-UGCCUCAAACUUAAAUAGUAUAAaa-3' | (SEQ ID NO: 3377) |
|  | 3'-UGACGGAGUUUGAAUUUAUCAUAUUUU-5' | (SEQ ID NO: 3521) |
| MYC-m2131 Target: | 5'-ACTGCCTCAAACTTAAATAGTATAAAA-3' | (SEQ ID NO: 3665) |
|  | 5'-CAAACUUAAAUAGUAUAAAAGAAct-3' | (SEQ ID NO: 3378) |
|  | 3'-GAGUUUGAAUUUAUCAUAUUUUCUUGA-5' | (SEQ ID NO: 3522) |
| MYC-m2136 Target: | 5'-CTCAAACTTAAATAGTATAAAAGAACT-3' | (SEQ ID NO: 3666) |
|  | 5'-AAAUAGUAUAAAAGAACUUUUUUtt-3' | (SEQ ID NO: 3379) |
|  | 3'-AAUUUAUCAUAUUUUCUUGAAAAAAAA-5' | (SEQ ID NO: 3523) |
| MYC-m2143 Target: | 5'-TTAAATAGTATAAAAGAACTTTTTTTT-3' | (SEQ ID NO: 3667) |
|  | 5'-UAUAAAAGAACUUUUUUUUAUGCtt-3' | (SEQ ID NO: 3380) |
|  | 3'-UCAUAUUUUCUUGAAAAAAAAUACGAA-5' | (SEQ ID NO: 3524) |
| MYC-m2149 Target: | 5'-AGTATAAAAGAACTTTTTTTTATGCTT-3' | (SEQ ID NO: 3668) |
|  | 5'-AAGAACUUUUUUUUAUGCUUCCCat-3' | (SEQ ID NO: 3381) |
|  | 3'-UUUUCUUGAAAAAAAAUACGAAGGGUA-5' | (SEQ ID NO: 3525) |
| MYC-m2154 Target: | 5'-AAAAGAACTTTTTTTTATGCTTCCCAT-3' | (SEQ ID NO: 3669) |
|  | 5'-CUUUUUUUUAUGCUUCCCAUCUUtt-3' | (SEQ ID NO: 3382) |
|  | 3'-UUGAAAAAAAAUACGAAGGGUAGAAAA-5' | (SEQ ID NO: 3526) |
| MYC-m2159 Target: | 5'-AACTTTTTTTTATGCTTCCCATCTTTT-3' | (SEQ ID NO: 3670) |
|  | 5'-UUAUGCUUCCCAUCUUUUUUCUUtt-3' | (SEQ ID NO: 3383) |
|  | 3'-AAAAUACGAAGGGUAGAAAAAAGAAAA-5' | (SEQ ID NO: 3527) |
| MYC-m2166 Target: | 5'-TTTTATGCTTCCCATCTTTTTTCTTTT-3' | (SEQ ID NO: 3671) |
|  | 5'-CUUCCCAUCUUUUUUCUUUUUCCtt-3' | (SEQ ID NO: 3384) |
|  | 3'-ACGAAGGGUAGAAAAAGAAAAAGGAA-5' | (SEQ ID NO: 3528) |
| MYC-m2171 Target: | 5'-TGCTTCCCATCTTTTTTCTTTTCCTT-3' | (SEQ ID NO: 3672) |
|  | 5'-AUCUUUUUUCUUUUCCUUUUAAca-3' | (SEQ ID NO: 3385) |
|  | 3'-GGUAGAAAAAGAAAAGGAAAAUUGU-5' | (SEQ ID NO: 3529) |
| MYC-m2177 Target: | 5'-CCATCTTTTTTCTTTTCCTTTTAACA-3' | (SEQ ID NO: 3673) |
|  | 5'-UUUUUCCUUUUAACAGAUUUGUAtt-3' | (SEQ ID NO: 3386) |
|  | 3'-AGAAAAGGAAAAUUGUCUAAACAUAA-5' | (SEQ ID NO: 3530) |
| MYC-m2187 Target: | 5'-TCTTTTTCCTTTTAACAGATTTGTATT-3' | (SEQ ID NO: 3674) |
|  | 5'-UUUUAACAGAUUUGUAUUUAAUUgt-3' | (SEQ ID NO: 3387) |
|  | 3'-GGAAAAUUGUCUAAACAUAAAUUAACA-5' | (SEQ ID NO: 3531) |
| MYC-m2194 Target: | 5'-CCTTTTAACAGATTTGTATTTAATTGT-3' | (SEQ ID NO: 3675) |

TABLE 4-continued

Selected Mouse Anti-MYC DsiRNAs (Asymmetrics)

|  |  |  |  |
|---|---|---|---|
|  | 5'-CAGAUUUGUAUUUAAUUGUUUUUtt-3' | (SEQ ID NO: 3388) |
|  | 3'-<u>UUG</u>UCUAAACAUAAAUUAACAAAAA<u>AA</u>-5' | (SEQ ID NO: 3532) |
| MYC-m2200 Target: | 5'-AACAGATTTGTATTTAATTGTTTTTTT-3' | (SEQ ID NO: 3676) |
|  | 5'-UAUUUAAUUGUUUUUUUAAAAAAat-3' | (SEQ ID NO: 3389) |
|  | 3'-<u>ACA</u>UAAAUUAACAAAAAAAUUUUUU<u>UA</u>-5' | (SEQ ID NO: 3533) |
| MYC-m2208 Target: | 5'-TGTATTTAATTGTTTTTTTAAAAAAAT-3' | (SEQ ID NO: 3677) |
|  | 5'-GUUUUUUUAAAAAAAUCUUAAAAtc-3' | (SEQ ID NO: 3390) |
|  | 3'-<u>AAC</u>AAAAAAAUUUUUUAGAAUUUU<u>AG</u>-5' | (SEQ ID NO: 3534) |
| MYC-m2217 Target: | 5'-TTGTTTTTTTAAAAAAATCTTAAAATC-3' | (SEQ ID NO: 3678) |
|  | 5'-UAAAAAAAUCUUAAAAUCUAUCCaa-3' | (SEQ ID NO: 3391) |
|  | 3'-<u>AAA</u>UUUUUUAGAAUUUUAGAUAGG<u>UU</u>-5' | (SEQ ID NO: 3535) |
| MYC-m2224 Target: | 5'-TTTAAAAAAATCTTAAAATCTATCCAA-3' | (SEQ ID NO: 3679) |
|  | 5'-AAAUCUUAAAAUCUAUCCAAUUUtc-3' | (SEQ ID NO: 3392) |
|  | 3'-<u>UUU</u>UUAGAAUUUUAGAUAGGUUAAA<u>AG</u>-5' | (SEQ ID NO: 3536) |
| MYC-m2229 Target: | 5'-AAAAATCTTAAAATCTATCCAATTTTC-3' | (SEQ ID NO: 3680) |
|  | 5'-AAAAUCUAUCCAAUUUUCCCAUGta-3' | (SEQ ID NO: 3393) |
|  | 3'-<u>AAU</u>UUUAGAUAGGUUAAAAGGGUAC<u>AU</u>-5' | (SEQ ID NO: 3537) |
| MYC-m2236 Target: | 5'-TTAAAATCTATCCAATTTTCCCATGTA-3' | (SEQ ID NO: 3681) |
|  | 5'-CUAUCCAAUUUUCCCAUGUAAAUag-3' | (SEQ ID NO: 3394) |
|  | 3'-<u>UAG</u>AUAGGUUAAAAGGGUACAUUUA<u>UC</u>-5' | (SEQ ID NO: 3538) |
| MYC-m2241 Target: | 5'-ATCTATCCAATTTTCCCATGTAAATAG-3' | (SEQ ID NO: 3682) |
|  | 5'-CAUGUAAAUAGGGCCUUGAAAUGta-3' | (SEQ ID NO: 3395) |
|  | 3'-<u>GGG</u>UACAUUUAUCCCGGAACUUUAC<u>AU</u>-5' | (SEQ ID NO: 3539) |
| MYC-m2255 Target: | 5'-CCCATGTAAATAGGGCCTTGAAATGTA-3' | (SEQ ID NO: 3683) |
|  | 5'-AAAUAGGGCCUUGAAAUGUAAAUaa-3' | (SEQ ID NO: 3396) |
|  | 3'-<u>CAU</u>UUAUCCCGGAACUUUACAUUUA<u>UU</u>-5' | (SEQ ID NO: 3540) |
| MYC-m2260 Target: | 5'-GTAAATAGGGCCTTGAAATGTAAATAA-3' | (SEQ ID NO: 3684) |
|  | 5'-GGGCCUUGAAAUGUAAAUAACUUta-3' | (SEQ ID NO: 3397) |
|  | 3'-<u>AUC</u>CCGGAACUUUACAUUUAUUGAA<u>AU</u>-5' | (SEQ ID NO: 3541) |
| MYC-m2265 Target: | 5'-TAGGGCCTTGAAATGTAAATAACTTTA-3' | (SEQ ID NO: 3685) |
|  | 5'-UUGAAAUGUAAAUAACUUUAAUAaa-3' | (SEQ ID NO: 3398) |
|  | 3'-<u>GGA</u>ACUUUACAUUUAUUGAAAUUAU<u>UU</u>-5' | (SEQ ID NO: 3542) |
| MYC-m2270 Target: | 5'-CCTTGAAATGTAAATAACTTTAATAAA-3' | (SEQ ID NO: 3686) |
|  | 5'-UUUAAUAAAACGUUUAUAACAGUta-3' | (SEQ ID NO: 3399) |
|  | 3'-<u>UGA</u>AAUUAUUUUGCAAAUAUUGUCA<u>AU</u>-5' | (SEQ ID NO: 3543) |
| MYC-m2286 Target: | 5'-ACTTTAATAAAACGTTTATAACAGTTA-3' | (SEQ ID NO: 3687) |
|  | 5'-UAAAACGUUUAUAACAGUUACAAaa-3' | (SEQ ID NO: 3400) |
|  | 3'-<u>UUA</u>UUUUGCAAAUAUUGUCAAUGUU<u>UU</u>-5' | (SEQ ID NO: 3544) |
| MYC-m2291 Target: | 5'-AATAAAACGTTTATAACAGTTACAAAA-3' | (SEQ ID NO: 3688) |

TABLE 4-continued

Selected Mouse Anti-MYC DsiRNAs (Asymmetrics)

|  |  |  |  |
|---|---|---|---|
|  | 5'-CGUUUAUAACAGUUACAAAAGAUtt-3' | (SEQ ID NO: 3401) |  |
|  | 3'-UUGCAAAUAUUGUCAAUGUUUUCUAAA-5' | (SEQ ID NO: 3545) |  |
| MYC-m2296 Target: | 5'-AACGTTTATAACAGTTACAAAAGATTT-3' | (SEQ ID NO: 3689) |  |
|  | 5'-CAGUUACAAAAGAUUUUAAGACAtg-3' | (SEQ ID NO: 3402) |  |
|  | 3'-UUGUCAAUGUUUUCUAAAAUUCUGUAC-5' | (SEQ ID NO: 3546) |  |
| MYC-m2305 Target: | 5'-AACAGTTACAAAAGATTTTAAGACATG-3' | (SEQ ID NO: 3690) |  |
|  | 5'-CAAAAGAUUUUAAGACAUGUACCat-3' | (SEQ ID NO: 3403) |  |
|  | 3'-AUGUUUUCUAAAAUUCUGUACAUGGUA-5' | (SEQ ID NO: 3547) |  |
| MYC-m2311 Target: | 5'-TACAAAAGATTTTAAGACATGTACCAT-3' | (SEQ ID NO: 3691) |  |
|  | 5'-AUUUUAAGACAUGUACCAUAAUUtt-3' | (SEQ ID NO: 3404) |  |
|  | 3'-UCUAAAAUUCUGUACAUGGUAUUAAAA-5' | (SEQ ID NO: 3548) |  |
| MYC-m2317 Target: | 5'-AGATTTTAAGACATGTACCATAATTTT-3' | (SEQ ID NO: 3692) |  |
|  | 5'-GACAUGUACCAUAAUUUUUUUAtt-3' | (SEQ ID NO: 3405) |  |
|  | 3'-UUCUGUACAUGGUAUUAAAAAAAAUAA-5' | (SEQ ID NO: 3549) |  |
| MYC-m2324 Target: | 5'-AAGACATGTACCATAATTTTTTTATT-3' | (SEQ ID NO: 3693) |  |
|  | 5'-CAUAAUUUUUUUAUUUAAAGACat-3' | (SEQ ID NO: 3406) |  |
|  | 3'-UGGUAUUAAAAAAAUAAAUUUCUGUA-5' | (SEQ ID NO: 3550) |  |
| MYC-m2333 Target: | 5'-ACCATAATTTTTTTATTTAAAGACAT-3' | (SEQ ID NO: 3694) |  |
|  | 5'-UUUUUUUAUUUAAAGACAUUUUca-3' | (SEQ ID NO: 3407) |  |
|  | 3'-UUAAAAAAAUAAAUUUCUGUAAAAGU-5' | (SEQ ID NO: 3551) |  |
| MYC-m2338 Target: | 5'-AATTTTTTTATTTAAAGACATTTTCA-3' | (SEQ ID NO: 3695) |  |
|  | 5'-AUUUAAAGACAUUUUCAUUUUUAaa-3' | (SEQ ID NO: 3408) |  |
|  | 3'-AAUAAAUUUCUGUAAAAGUAAAAAUUU-5' | (SEQ ID NO: 3552) |  |
| MYC-m2346 Target: | 5'-TTATTTAAAGACATTTTCATTTTTAAA-3' | (SEQ ID NO: 3696) |  |
|  | 5'-AAGACAUUUUCAUUUUUAAAGUUga-3' | (SEQ ID NO: 3409) |  |
|  | 3'-AUUUCUGUAAAAGUAAAAAUUUCAACU-5' | (SEQ ID NO: 3553) |  |
| MYC-m2351 Target: | 5'-TAAAGACATTTTCATTTTTAAAGTTGA-3' | (SEQ ID NO: 3697) |  |
|  | 5'-AUUUUCAUUUUUAAAGUUGAUUtt-3' | (SEQ ID NO: 3410) |  |
|  | 3'-UGUAAAAGUAAAAAUUUCAACUAAAAA-5' | (SEQ ID NO: 3554) |  |
| MYC-m2356 Target: | 5'-ACATTTTCATTTTTAAAGTTGATTTT-3' | (SEQ ID NO: 3698) |  |
|  | 5'-AUUUUUAAAGUUGAUUUUUUUCUat-3' | (SEQ ID NO: 3411) |  |
|  | 3'-AGUAAAAAUUUCAACUAAAAAAGAUA-5' | (SEQ ID NO: 3555) |  |
| MYC-m2362 Target: | 5'-TCATTTTTAAAGTTGATTTTTTCTAT-3' | (SEQ ID NO: 3699) |  |
|  | 5'-UAUUGUUUUUAGAAAAAAAUAAAat-3' | (SEQ ID NO: 3412) |  |
|  | 3'-AGAUAACAAAAAUCUUUUUUUAUUUA-5' | (SEQ ID NO: 3556) |  |
| MYC-m2384 Target: | 5'-TCTATTGTTTTTAGAAAAAAATAAAT-3' | (SEQ ID NO: 3700) |  |
|  | 5'-UUUUAGAAAAAAAUAAAUAAUUgg-3' | (SEQ ID NO: 3413) |  |
|  | 3'-CAAAAAUCUUUUUUUAUUUAUUAACC-5' | (SEQ ID NO: 3557) |  |
| MYC-m2390 Target: | 5'-GTTTTTAGAAAAAAATAAATAATTGG-3' | (SEQ ID NO: 3701) |  |

TABLE 4-continued

Selected Mouse Anti-MYC DsiRNAs (Asymmetrics)

```
               5'-AAAAAAUAAAAUAAUUGGAAAAAat-3'    (SEQ ID NO: 3414)

3'-CUUUUUUAUUUUAUUAACCUUUUUUA-5'   (SEQ ID NO: 3558)

MYC-m2397 Target:  5'-GAAAAAAATAAAATAATTGGAAAAAAT-3'  (SEQ ID NO: 3702)
```

TABLE 5

DsiRNA Target Sequences (21mers) In MYC mRNA

| | | |
|---|---|---|
| MYC-94 21 nt Target: | 5'-CUCGAGAAGGGCAGGGCUUCU-3' | (SEQ ID NO: 1309) |
| MYC-178 21 nt Target: | 5'-GGGCUUUAUCUAACUCGCUGU-3' | (SEQ ID NO: 1310) |
| MYC-365 21 nt Target: | 5'-AACCCUUGCCGCAUCCACGAA-3' | (SEQ ID NO: 1311) |
| MYC-370 21 nt Target: | 5'-UUGCCGCAUCCACGAAACUUU-3' | (SEQ ID NO: 1312) |
| MYC-376 21 nt Target: | 5'-CAUCCACGAAACUUUGCCCAU-3' | (SEQ ID NO: 1313) |
| MYC-403 21 nt Target: | 5'-GGGCGGGCACUUUGCACUGGA-3' | (SEQ ID NO: 1314) |
| MYC-409 21 nt Target: | 5'-GCACUUUGCACUGGAACUUAC-3' | (SEQ ID NO: 1315) |
| MYC-417 21 nt Target: | 5'-CACUGGAACUUACAACACCCG-3' | (SEQ ID NO: 1316) |
| MYC-535 21 nt Target: | 5'-UUGCAGCUGCUUAGACGCUGG-3' | (SEQ ID NO: 1317) |
| MYC-541 21 nt Target: | 5'-CUGCUUAGACGCUGGAUUUUU-3' | (SEQ ID NO: 1318) |
| MYC-548 21 nt Target: | 5'-GACGCUGGAUUUUUUCGGGU-3' | (SEQ ID NO: 1319) |
| MYC-553 21 nt Target: | 5'-UGGAUUUUUUCGGGUAGUGG-3' | (SEQ ID NO: 1320) |
| MYC-562 21 nt Target: | 5'-UUCGGGUAGUGGAAAACCAGC-3' | (SEQ ID NO: 1321) |
| MYC-601 21 nt Target: | 5'-CCCUCAACGUUAGCUUCACCA-3' | (SEQ ID NO: 1322) |
| MYC-607 21 nt Target: | 5'-ACGUUAGCUUCACCAACAGGA-3' | (SEQ ID NO: 1323) |
| MYC-643 21 nt Target: | 5'-ACGACUCGGUGCAGCCGUAUU-3' | (SEQ ID NO: 1324) |
| MYC-651 21 nt Target: | 5'-GUGCAGCCGUAUUUCUACUGC-3' | (SEQ ID NO: 1325) |
| MYC-676 21 nt Target: | 5'-AGGAGGAGAACUUCUACCAGC-3' | (SEQ ID NO: 1326) |
| MYC-731 21 nt Target: | 5'-CAGCGAGGAUAUCUGGAAGAA-3' | (SEQ ID NO: 1327) |
| MYC-816 21 nt Target: | 5'-UACGUUGCGGUCACACCCUUC-3' | (SEQ ID NO: 1328) |
| MYC-920 21 nt Target: | 5'-AGACAUGGUGAACCAGAGUUU-3' | (SEQ ID NO: 1329) |
| MYC-949 21 nt Target: | 5'-ACCCGGACGACGAGACCUUCA-3' | (SEQ ID NO: 1330) |
| MYC-958 21 nt Target: | 5'-ACGAGACCUUCAUCAAAAACA-3' | (SEQ ID NO: 1331) |
| MYC-970 21 nt Target: | 5'-UCAAAAACAUCAUCAUCCAGG-3' | (SEQ ID NO: 1332) |
| MYC-987 21 nt Target: | 5'-CAGGACUGUAUGUGGAGCGGC-3' | (SEQ ID NO: 1333) |
| MYC-1104 21 nt Target: | 5'-GUCUGCUCCACCUCCAGCUUG-3' | (SEQ ID NO: 1334) |
| MYC-1111 21 nt Target: | 5'-CCACCUCCAGCUUGUACCUGC-3' | (SEQ ID NO: 1335) |
| MYC-1116 21 nt Target: | 5'-UCCAGCUUGUACCUGCAGGAU-3' | (SEQ ID NO: 1336) |
| MYC-1210 21 nt Target: | 5'-CCAAGUCCUGCGCCUCGCAAG-3' | (SEQ ID NO: 1337) |
| MYC-1340 21 nt Target: | 5'-CAGCAGCGACUCUGAGGAGGA-3' | (SEQ ID NO: 1338) |
| MYC-1346 21 nt Target: | 5'-CGACUCUGAGGAGGAACAAGA-3' | (SEQ ID NO: 1339) |
| MYC-1351 21 nt Target: | 5'-CUGAGGAGGAACAAGAAGAUG-3' | (SEQ ID NO: 1340) |
| MYC-1358 21 nt Target: | 5'-GGAACAAGAAGAUGAGGAAGA-3' | (SEQ ID NO: 1341) |

TABLE 5-continued

DsiRNA Target Sequences (21mers) In MYC mRNA

MYC-1364 21 nt Target: 5'-AGAAGAUGAGGAAGAAAUCGA-3' (SEQ ID NO: 1342)

MYC-1370 21 nt Target: 5'-UGAGGAAGAAAUCGAUGUUGU-3' (SEQ ID NO: 1343)

MYC-1376 21 nt Target: 5'-AGAAAUCGAUGUUGUUUCUGU-3' (SEQ ID NO: 1344)

MYC-1382 21 nt Target: 5'-CGAUGUUGUUUCUGUGGAAAA-3' (SEQ ID NO: 1345)

MYC-1401 21 nt Target: 5'-AAGAGGCAGGCUCCUGGCAAA-3' (SEQ ID NO: 1346)

MYC-1406 21 nt Target: 5'-GCAGGCUCCUGGCAAAAGGUC-3' (SEQ ID NO: 1347)

MYC-1411 21 nt Target: 5'-CUCCUGGCAAAAGGUCAGAGU-3' (SEQ ID NO: 1348)

MYC-1416 21 nt Target: 5'-GGCAAAAGGUCAGAGUCUGGA-3' (SEQ ID NO: 1349)

MYC-1421 21 nt Target: 5'-AAGGUCAGAGUCUGGAUCACC-3' (SEQ ID NO: 1350)

MYC-1457 21 nt Target: 5'-CAGCAAACCUCCUCACAGCCC-3' (SEQ ID NO: 1351)

MYC-1465 21 nt Target: 5'-CUCCUCACAGCCCACUGGUCC-3' (SEQ ID NO: 1352)

MYC-1531 21 nt Target: 5'-CUCCCUCCACUCGGAAGGACU-3' (SEQ ID NO: 1353)

MYC-1538 21 nt Target: 5'-CACUCGGAAGGACUAUCCUGC-3' (SEQ ID NO: 1354)

MYC-1550 21 nt Target: 5'-CUAUCCUGCUGCCAAGAGGGU-3' (SEQ ID NO: 1355)

MYC-1555 21 nt Target: 5'-CUGCUGCCAAGAGGGUCAAGU-3' (SEQ ID NO: 1356)

MYC-1560 21 nt Target: 5'-GCCAAGAGGGUCAAGUUGGAC-3' (SEQ ID NO: 1357)

MYC-1565 21 nt Target: 5'-GAGGGUCAAGUUGGACAGUGU-3' (SEQ ID NO: 1358)

MYC-1570 21 nt Target: 5'-UCAAGUUGGACAGUGUCAGAG-3' (SEQ ID NO: 1359)

MYC-1575 21 nt Target: 5'-UUGGACAGUGUCAGAGUCCUG-3' (SEQ ID NO: 1360)

MYC-1584 21 nt Target: 5'-GUCAGAGUCCUGAGACAGAUC-3' (SEQ ID NO: 1361)

MYC-1593 21 nt Target: 5'-CUGAGACAGAUCAGCAACAAC-3' (SEQ ID NO: 1362)

MYC-1599 21 nt Target: 5'-CAGAUCAGCAACAACCGAAAA-3' (SEQ ID NO: 1363)

MYC-1634 21 nt Target: 5'-GUCCUCGGACACCGAGGAGAA-3' (SEQ ID NO: 1364)

MYC-1639 21 nt Target: 5'-CGGACACCGAGGAGAAUGUCA-3' (SEQ ID NO: 1365)

MYC-1687 21 nt Target: 5'-GCCAGAGGAGGAACGAGCUAA-3' (SEQ ID NO: 1366)

MYC-1693 21 nt Target: 5'-GGAGGAACGAGCUAAAACGGA-3' (SEQ ID NO: 1367)

MYC-1698 21 nt Target: 5'-AACGAGCUAAAACGGAGCUUU-3' (SEQ ID NO: 1368)

MYC-1704 21 nt Target: 5'-CUAAAACGGAGCUUUUUUGCC-3' (SEQ ID NO: 1369)

MYC-1709 21 nt Target: 5'-ACGGAGCUUUUUUGCCCUGCG-3' (SEQ ID NO: 1370)

MYC-1729 21 nt Target: 5'-GUGACCAGAUCCCGGAGUUGG-3' (SEQ ID NO: 1371)

MYC-1734 21 nt Target: 5'-CAGAUCCCGGAGUUGGAAAAC-3' (SEQ ID NO: 1372)

MYC-1739 21 nt Target: 5'-CCCGGAGUUGGAAAACAAUGA-3' (SEQ ID NO: 1373)

MYC-1769 21 nt Target: 5'-CAAGGUAGUUAUCCUUAAAAA-3' (SEQ ID NO: 1374)

MYC-1774 21 nt Target: 5'-UAGUUAUCCUUAAAAAAGCCA-3' (SEQ ID NO: 1375)

MYC-1779 21 nt Target: 5'-AUCCUUAAAAAAGCCACAGCA-3' (SEQ ID NO: 1376)

MYC-1784 21 nt Target: 5'-UAAAAAAGCCACAGCAUACAU-3' (SEQ ID NO: 1377)

MYC-1789 21 nt Target: 5'-AAGCCACAGCAUACAUCCUGU-3' (SEQ ID NO: 1378)

MYC-1795 21 nt Target: 5'-CAGCAUACAUCCUGUCCGUCC-3' (SEQ ID NO: 1379)

MYC-1803 21 nt Target: 5'-AUCCUGUCCGUCCAAGCAGAG-3' (SEQ ID NO: 1380)

TABLE 5-continued

DsiRNA Target Sequences (21mers) In MYC mRNA

MYC-1808 21 nt Target: 5'-GUCCGUCCAAGCAGAGGAGCA-3' (SEQ ID NO: 1381)

MYC-1816 21 nt Target: 5'-AAGCAGAGGAGCAAAAGCUCA-3' (SEQ ID NO: 1382)

MYC-1823 21 nt Target: 5'-GGAGCAAAAGCUCAUUUCUGA-3' (SEQ ID NO: 1383)

MYC-1828 21 nt Target: 5'-AAAAGCUCAUUUCUGAAGAGG-3' (SEQ ID NO: 1384)

MYC-1834 21 nt Target: 5'-UCAUUUCUGAAGAGGACUUGU-3' (SEQ ID NO: 1385)

MYC-1840 21 nt Target: 5'-CUGAAGAGGACUUGUUGCGGA-3' (SEQ ID NO: 1386)

MYC-1845 21 nt Target: 5'-GAGGACUUGUUGCGGAAACGA-3' (SEQ ID NO: 1387)

MYC-1850 21 nt Target: 5'-CUUGUUGCGGAAACGACGAGA-3' (SEQ ID NO: 1388)

MYC-1855 21 nt Target: 5'-UGCGGAAACGACGAGAACAGU-3' (SEQ ID NO: 1389)

MYC-1882 21 nt Target: 5'-ACAAACUUGAACAGCUACGGA-3' (SEQ ID NO: 1390)

MYC-1888 21 nt Target: 5'-UUGAACAGCUACGGAACUCUU-3' (SEQ ID NO: 1391)

MYC-1893 21 nt Target: 5'-CAGCUACGGAACUCUUGUGCG-3' (SEQ ID NO: 1392)

MYC-1900 21 nt Target: 5'-GGAACUCUUGUGCGUAAGGAA-3' (SEQ ID NO: 1393)

MYC-1906 21 nt Target: 5'-CUUGUGCGUAAGGAAAAGUAA-3' (SEQ ID NO: 1394)

MYC-1911 21 nt Target: 5'-GCGUAAGGAAAAGUAAGGAAA-3' (SEQ ID NO: 1395)

MYC-1921 21 nt Target: 5'-AAGUAAGGAAAACGAUUCCUU-3' (SEQ ID NO: 1396)

MYC-1926 21 nt Target: 5'-AGGAAAACGAUUCCUUCUAAC-3' (SEQ ID NO: 1397)

MYC-1931 21 nt Target: 5'-AACGAUUCCUUCUAACAGAAA-3' (SEQ ID NO: 1398)

MYC-1937 21 nt Target: 5'-UCCUUCUAACAGAAAUGUCCU-3' (SEQ ID NO: 1399)

MYC-1944 21 nt Target: 5'-AACAGAAAUGUCCUGAGCAAU-3' (SEQ ID NO: 1400)

MYC-1953 21 nt Target: 5'-GUCCUGAGCAAUCACCUAUGA-3' (SEQ ID NO: 1401)

MYC-1959 21 nt Target: 5'-AGCAAUCACCUAUGAACUUGU-3' (SEQ ID NO: 1402)

MYC-1965 21 nt Target: 5'-CACCUAUGAACUUGUUUCAAA-3' (SEQ ID NO: 1403)

MYC-1970 21 nt Target: 5'-AUGAACUUGUUUCAAAUGCAU-3' (SEQ ID NO: 1404)

MYC-1976 21 nt Target: 5'-UUGUUUCAAAUGCAUGAUCAA-3' (SEQ ID NO: 1405)

MYC-1981 21 nt Target: 5'-UCAAAUGCAUGAUCAAAUGCA-3' (SEQ ID NO: 1406)

MYC-1989 21 nt Target: 5'-AUGAUCAAAUGCAACCUCACA-3' (SEQ ID NO: 1407)

MYC-1994 21 nt Target: 5'-CAAAUGCAACCUCACAACCUU-3' (SEQ ID NO: 1408)

MYC-2001 21 nt Target: 5'-AACCUCACAACCUUGGCUGAG-3' (SEQ ID NO: 1409)

MYC-2006 21 nt Target: 5'-CACAACCUUGGCUGAGUCUUG-3' (SEQ ID NO: 1410)

MYC-2013 21 nt Target: 5'-UUGGCUGAGUCUUGAGACUGA-3' (SEQ ID NO: 1411)

MYC-2019 21 nt Target: 5'-GAGUCUUGAGACUGAAAGAUU-3' (SEQ ID NO: 1412)

MYC-2026 21 nt Target: 5'-GAGACUGAAAGAUUUAGCCAU-3' (SEQ ID NO: 1413)

MYC-2031 21 nt Target: 5'-UGAAAGAUUUAGCCAUAAUGU-3' (SEQ ID NO: 1414)

MYC-2040 21 nt Target: 5'-UAGCCAUAAUGUAAACUGCCU-3' (SEQ ID NO: 1415)

MYC-2048 21 nt Target: 5'-AUGUAAACUGCCUCAAAUUGG-3' (SEQ ID NO: 1416)

MYC-2054 21 nt Target: 5'-ACUGCCUCAAAUUGGACUUUG-3' (SEQ ID NO: 1417)

MYC-2059 21 nt Target: 5'-CUCAAAUUGGACUUUGGGCAU-3' (SEQ ID NO: 1418)

MYC-2066 21 nt Target: 5'-UGGACUUUGGGCAUAAAAGAA-3' (SEQ ID NO: 1419)

TABLE 5-continued

DsiRNA Target Sequences (21mers) In MYC mRNA

MYC-2073 21 nt Target:  5'-UGGGCAUAAAAGAACUUUUUU-3'  (SEQ ID NO: 1420)

MYC-2078 21 nt Target:  5'-AUAAAAGAACUUUUUUAUGCU-3'  (SEQ ID NO: 1421)

MYC-2083 21 nt Target:  5'-AGAACUUUUUUAUGCUUACCA-3'  (SEQ ID NO: 1422)

MYC-2089 21 nt Target:  5'-UUUUUAUGCUUACCAUCUUUU-3'  (SEQ ID NO: 1423)

MYC-2094 21 nt Target:  5'-AUGCUUACCAUCUUUUUUUU-3'  (SEQ ID NO: 1424)

MYC-2099 21 nt Target:  5'-UACCAUCUUUUUUUUUCUUU-3'  (SEQ ID NO: 1425)

MYC-2105 21 nt Target:  5'-CUUUUUUUUUUCUUUAACAGA-3'  (SEQ ID NO: 1426)

MYC-2114 21 nt Target:  5'-UUCUUUAACAGAUUUGUAUUU-3'  (SEQ ID NO: 1427)

MYC-2120 21 nt Target:  5'-AACAGAUUUGUAUUUAAGAAU-3'  (SEQ ID NO: 1428)

MYC-2128 21 nt Target:  5'-UGUAUUUAAGAAUUGUUUUUA-3'  (SEQ ID NO: 1429)

MYC-2135 21 nt Target:  5'-AAGAAUUGUUUUUAAAAAAUU-3'  (SEQ ID NO: 1430)

MYC-2167 21 nt Target:  5'-ACAAUGUUUCUCUGUAAAUAU-3'  (SEQ ID NO: 1431)

MYC-2176 21 nt Target:  5'-CUCUGUAAAUAUUGCCAUUAA-3'  (SEQ ID NO: 1432)

MYC-2181 21 nt Target:  5'-UAAAUAUUGCCAUUAAAUGUA-3'  (SEQ ID NO: 1433)

MYC-2188 21 nt Target:  5'-UGCCAUUAAAUGUAAAUAACU-3'  (SEQ ID NO: 1434)

MYC-2207 21 nt Target:  5'-CUUUAAUAAAACGUUUAUAGC-3'  (SEQ ID NO: 1435)

MYC-2233 21 nt Target:  5'-CACAGAAUUUCAAUCCUAGUA-3'  (SEQ ID NO: 1436)

MYC-2260 21 nt Target:  5'-ACCUAGUAUUAUAGGUACUAU-3'  (SEQ ID NO: 1437)

MYC-2267 21 nt Target:  5'-AUUAUAGGUACUAUAAACCCU-3'  (SEQ ID NO: 1438)

MYC-2274 21 nt Target:  5'-GUACUAUAAACCCUAAUUUUU-3'  (SEQ ID NO: 1439)

MYC-2282 21 nt Target:  5'-AACCCUAAUUUUUUUAUUUA-3'  (SEQ ID NO: 1440)

MYC-2287 21 nt Target:  5'-UAAUUUUUUUAUUUAAGUAC-3'  (SEQ ID NO: 1441)

MYC-2295 21 nt Target:  5'-UUUAUUUAAGUACAUUUUGCU-3'  (SEQ ID NO: 1442)

MYC-2300 21 nt Target:  5'-UUAAGUACAUUUUGCUUUUUA-3'  (SEQ ID NO: 1443)

MYC-2306 21 nt Target:  5'-ACAUUUUGCUUUUUAAAGUUG-3'  (SEQ ID NO: 1444)

MYC-2312 21 nt Target:  5'-UGCUUUUUAAAGUUGAUUUUU-3'  (SEQ ID NO: 1445)

MYC-2334 21 nt Target:  5'-UCUAUUGUUUUUAGAAAAAAU-3'  (SEQ ID NO: 1446)

MYC-2339 21 nt Target:  5'-UGUUUUUAGAAAAAAUAAAAU-3'  (SEQ ID NO: 1447)

MYC-2347 21 nt Target:  5'-GAAAAAAUAAAAUAACUGGCA-3'  (SEQ ID NO: 1448)

MYC-2355 21 nt Target:  5'-AAAAUAACUGGCAAAUAUAUC-3'  (SEQ ID NO: 1449)

MYC-2364 21 nt Target:  5'-GGCAAAUAUAUCAUUGAGCCA-3'  (SEQ ID NO: 1450)

MYC-2371 21 nt Target:  5'-AUAUCAUUGAGCCAAAUCUUA-3'  (SEQ ID NO: 1451)

MYC-2377 21 nt Target:  5'-UUGAGCCAAAUCUUAAAAAAA-3'  (SEQ ID NO: 1452)

MYC-188 21 nt Target:   5'-UAACUCGCUGUAGUAAUUCCA-3'  (SEQ ID NO: 1453)

MYC-189 21 nt Target:   5'-AACUCGCUGUAGUAAUUCCAG-3'  (SEQ ID NO: 1454)

MYC-190 21 nt Target:   5'-ACUCGCUGUAGUAAUUCCAGC-3'  (SEQ ID NO: 1455)

MYC-191 21 nt Target:   5'-CUCGCUGUAGUAAUUCCAGCG-3'  (SEQ ID NO: 1456)

MYC-192 21 nt Target:   5'-UCGCUGUAGUAAUUCCAGCGA-3'  (SEQ ID NO: 1457)

MYC-193 21 nt Target:   5'-CGCUGUAGUAAUUCCAGCGAG-3'  (SEQ ID NO: 1458)

TABLE 5-continued

DsiRNA Target Sequences (21mers) In MYC mRNA

MYC-194 21 nt Target:  5'-GCUGUAGUAAUUCCAGCGAGA-3' (SEQ ID NO: 1459)

MYC-195 21 nt Target:  5'-CUGUAGUAAUUCCAGCGAGAG-3' (SEQ ID NO: 1460)

MYC-612 21 nt Target:  5'-AGCUUCACCAACAGGAACUAU-3' (SEQ ID NO: 1461)

MYC-613 21 nt Target:  5'-GCUUCACCAACAGGAACUAUG-3' (SEQ ID NO: 1462)

MYC-614 21 nt Target:  5'-CUUCACCAACAGGAACUAUGA-3' (SEQ ID NO: 1463)

MYC-615 21 nt Target:  5'-UUCACCAACAGGAACUAUGAC-3' (SEQ ID NO: 1464)

MYC-616 21 nt Target:  5'-UCACCAACAGGAACUAUGACC-3' (SEQ ID NO: 1465)

MYC-617 21 nt Target:  5'-CACCAACAGGAACUAUGACCU-3' (SEQ ID NO: 1466)

MYC-618 21 nt Target:  5'-ACCAACAGGAACUAUGACCUC-3' (SEQ ID NO: 1467)

MYC-619 21 nt Target:  5'-CCAACAGGAACUAUGACCUCG-3' (SEQ ID NO: 1468)

MYC-620 21 nt Target:  5'-CAACAGGAACUAUGACCUCGA-3' (SEQ ID NO: 1469)

MYC-621 21 nt Target:  5'-AACAGGAACUAUGACCUCGAC-3' (SEQ ID NO: 1470)

MYC-622 21 nt Target:  5'-ACAGGAACUAUGACCUCGACU-3' (SEQ ID NO: 1471)

MYC-623 21 nt Target:  5'-CAGGAACUAUGACCUCGACUA-3' (SEQ ID NO: 1472)

MYC-624 21 nt Target:  5'-AGGAACUAUGACCUCGACUAC-3' (SEQ ID NO: 1473)

MYC-625 21 nt Target:  5'-GGAACUAUGACCUCGACUACG-3' (SEQ ID NO: 1474)

MYC-626 21 nt Target:  5'-GAACUAUGACCUCGACUACGA-3' (SEQ ID NO: 1475)

MYC-627 21 nt Target:  5'-AACUAUGACCUCGACUACGAC-3' (SEQ ID NO: 1476)

MYC-628 21 nt Target:  5'-ACUAUGACCUCGACUACGACU-3' (SEQ ID NO: 1477)

MYC-629 21 nt Target:  5'-CUAUGACCUCGACUACGACUC-3' (SEQ ID NO: 1478)

MYC-733 21 nt Target:  5'-GCGAGGAUAUCUGGAAGAAAU-3' (SEQ ID NO: 1479)

MYC-734 21 nt Target:  5'-CGAGGAUAUCUGGAAGAAAUU-3' (SEQ ID NO: 1480)

MYC-735 21 nt Target:  5'-GAGGAUAUCUGGAAGAAAUUC-3' (SEQ ID NO: 1481)

MYC-736 21 nt Target:  5'-AGGAUAUCUGGAAGAAAUUCG-3' (SEQ ID NO: 1482)

MYC-737 21 nt Target:  5'-GGAUAUCUGGAAGAAAUUCGA-3' (SEQ ID NO: 1483)

MYC-738 21 nt Target:  5'-GAUAUCUGGAAGAAAUUCGAG-3' (SEQ ID NO: 1484)

MYC-739 21 nt Target:  5'-AUAUCUGGAAGAAAUUCGAGC-3' (SEQ ID NO: 1485)

MYC-740 21 nt Target:  5'-UAUCUGGAAGAAAUUCGAGCU-3' (SEQ ID NO: 1486)

MYC-741 21 nt Target:  5'-AUCUGGAAGAAAUUCGAGCUG-3' (SEQ ID NO: 1487)

MYC-742 21 nt Target:  5'-UCUGGAAGAAAUUCGAGCUGC-3' (SEQ ID NO: 1488)

MYC-743 21 nt Target:  5'-CUGGAAGAAAUUCGAGCUGCU-3' (SEQ ID NO: 1489)

MYC-784 21 nt Target:  5'-CUAGCCGCCGCUCCGGGCUCU-3' (SEQ ID NO: 1490)

MYC-785 21 nt Target:  5'-UAGCCGCCGCUCCGGGCUCUG-3' (SEQ ID NO: 1491)

MYC-786 21 nt Target:  5'-AGCCGCCGCUCCGGGCUCUGC-3' (SEQ ID NO: 1492)

MYC-787 21 nt Target:  5'-GCCGCCGCUCCGGGCUCUGCU-3' (SEQ ID NO: 1493)

MYC-788 21 nt Target:  5'-CCGCCGCUCCGGGCUCUGCUC-3' (SEQ ID NO: 1494)

MYC-913 21 nt Target:  5'-UGGGAGGAGACAUGGUGAACC-3' (SEQ ID NO: 1495)

MYC-914 21 nt Target:  5'-GGGAGGAGACAUGGUGAACCA-3' (SEQ ID NO: 1496)

MYC-915 21 nt Target:  5'-GGAGGAGACAUGGUGAACCAG-3' (SEQ ID NO: 1497)

TABLE 5-continued

DsiRNA Target Sequences (21mers) In MYC mRNA

MYC-916 21 nt Target:  5'-GAGGAGACAUGGUGAACCAGA-3'  (SEQ ID NO: 1498)

MYC-917 21 nt Target:  5'-AGGAGACAUGGUGAACCAGAG-3'  (SEQ ID NO: 1499)

MYC-952 21 nt Target:  5'-CGGACGACGAGACCUUCAUCA-3'  (SEQ ID NO: 1500)

MYC-953 21 nt Target:  5'-GGACGACGAGACCUUCAUCAA-3'  (SEQ ID NO: 1501)

MYC-973 21 nt Target:  5'-AAAACAUCAUCAUCCAGGACU-3'  (SEQ ID NO: 1502)

MYC-974 21 nt Target:  5'-AAACAUCAUCAUCCAGGACUG-3'  (SEQ ID NO: 1503)

MYC-975 21 nt Target:  5'-AACAUCAUCAUCCAGGACUGU-3'  (SEQ ID NO: 1504)

MYC-976 21 nt Target:  5'-ACAUCAUCAUCCAGGACUGUA-3'  (SEQ ID NO: 1505)

MYC-977 21 nt Target:  5'-CAUCAUCAUCCAGGACUGUAU-3'  (SEQ ID NO: 1506)

MYC-978 21 nt Target:  5'-AUCAUCAUCCAGGACUGUAUG-3'  (SEQ ID NO: 1507)

MYC-979 21 nt Target:  5'-UCAUCAUCCAGGACUGUAUGU-3'  (SEQ ID NO: 1508)

MYC-980 21 nt Target:  5'-CAUCAUCCAGGACUGUAUGUG-3'  (SEQ ID NO: 1509)

MYC-981 21 nt Target:  5'-AUCAUCCAGGACUGUAUGUGG-3'  (SEQ ID NO: 1510)

MYC-982 21 nt Target:  5'-UCAUCCAGGACUGUAUGUGGA-3'  (SEQ ID NO: 1511)

MYC-983 21 nt Target:  5'-CAUCCAGGACUGUAUGUGGAG-3'  (SEQ ID NO: 1512)

MYC-984 21 nt Target:  5'-AUCCAGGACUGUAUGUGGAGC-3'  (SEQ ID NO: 1513)

MYC-985 21 nt Target:  5'-UCCAGGACUGUAUGUGGAGCG-3'  (SEQ ID NO: 1514)

MYC-986 21 nt Target:  5'-CCAGGACUGUAUGUGGAGCGG-3'  (SEQ ID NO: 1515)

MYC-1033 21 nt Target:  5'-CAGAGAAGCUGGCCUCCUACC-3'  (SEQ ID NO: 1516)

MYC-1034 21 nt Target:  5'-AGAGAAGCUGGCCUCCUACCA-3'  (SEQ ID NO: 1517)

MYC-1035 21 nt Target:  5'-GAGAAGCUGGCCUCCUACCAG-3'  (SEQ ID NO: 1518)

MYC-1036 21 nt Target:  5'-AGAAGCUGGCCUCCUACCAGG-3'  (SEQ ID NO: 1519)

MYC-1037 21 nt Target:  5'-GAAGCUGGCCUCCUACCAGGC-3'  (SEQ ID NO: 1520)

MYC-1038 21 nt Target:  5'-AAGCUGGCCUCCUACCAGGCU-3'  (SEQ ID NO: 1521)

MYC-1039 21 nt Target:  5'-AGCUGGCCUCCUACCAGGCUG-3'  (SEQ ID NO: 1522)

MYC-1040 21 nt Target:  5'-GCUGGCCUCCUACCAGGCUGC-3'  (SEQ ID NO: 1523)

MYC-1041 21 nt Target:  5'-CUGGCCUCCUACCAGGCUGCG-3'  (SEQ ID NO: 1524)

MYC-1042 21 nt Target:  5'-UGGCCUCCUACCAGGCUGCGC-3'  (SEQ ID NO: 1525)

MYC-1043 21 nt Target:  5'-GGCCUCCUACCAGGCUGCGCG-3'  (SEQ ID NO: 1526)

MYC-1044 21 nt Target:  5'-GCCUCCUACCAGGCUGCGCGC-3'  (SEQ ID NO: 1527)

MYC-1045 21 nt Target:  5'-CCUCCUACCAGGCUGCGCGCA-3'  (SEQ ID NO: 1528)

MYC-1046 21 nt Target:  5'-CUCCUACCAGGCUGCGCGCAA-3'  (SEQ ID NO: 1529)

MYC-1047 21 nt Target:  5'-UCCUACCAGGCUGCGCGCAAA-3'  (SEQ ID NO: 1530)

MYC-1048 21 nt Target:  5'-CCUACCAGGCUGCGCGCAAAG-3'  (SEQ ID NO: 1531)

MYC-1049 21 nt Target:  5'-CUACCAGGCUGCGCGCAAAGA-3'  (SEQ ID NO: 1532)

MYC-1050 21 nt Target:  5'-UACCAGGCUGCGCGCAAAGAC-3'  (SEQ ID NO: 1533)

MYC-1051 21 nt Target:  5'-ACCAGGCUGCGCGCAAAGACA-3'  (SEQ ID NO: 1534)

MYC-1052 21 nt Target:  5'-CCAGGCUGCGCGCAAAGACAG-3'  (SEQ ID NO: 1535)

MYC-1053 21 nt Target:  5'-CAGGCUGCGCGCAAAGACAGC-3'  (SEQ ID NO: 1536)

TABLE 5-continued

DsiRNA Target Sequences (21mers) In MYC mRNA

MYC-1096 21 nt Target: 5'-GCCACAGCGUCUGCUCCACCU-3' (SEQ ID NO: 1537)

MYC-1097 21 nt Target: 5'-CCACAGCGUCUGCUCCACCUC-3' (SEQ ID NO: 1538)

MYC-1098 21 nt Target: 5'-CACAGCGUCUGCUCCACCUCC-3' (SEQ ID NO: 1539)

MYC-1099 21 nt Target: 5'-ACAGCGUCUGCUCCACCUCCA-3' (SEQ ID NO: 1540)

MYC-1100 21 nt Target: 5'-CAGCGUCUGCUCCACCUCCAG-3' (SEQ ID NO: 1541)

MYC-1101 21 nt Target: 5'-AGCGUCUGCUCCACCUCCAGC-3' (SEQ ID NO: 1542)

MYC-1189 21 nt Target: 5'-CUCUCAACGACAGCAGCUCGC-3' (SEQ ID NO: 1543)

MYC-1190 21 nt Target: 5'-UCUCAACGACAGCAGCUCGCC-3' (SEQ ID NO: 1544)

MYC-1191 21 nt Target: 5'-CUCAACGACAGCAGCUCGCCC-3' (SEQ ID NO: 1545)

MYC-1192 21 nt Target: 5'-UCAACGACAGCAGCUCGCCCA-3' (SEQ ID NO: 1546)

MYC-1193 21 nt Target: 5'-CAACGACAGCAGCUCGCCCAA-3' (SEQ ID NO: 1547)

MYC-1315 21 nt Target: 5'-UCCAUGAGGAGACACCGCCCA-3' (SEQ ID NO: 1548)

MYC-1316 21 nt Target: 5'-CCAUGAGGAGACACCGCCCAC-3' (SEQ ID NO: 1549)

MYC-1317 21 nt Target: 5'-CAUGAGGAGACACCGCCCACC-3' (SEQ ID NO: 1550)

MYC-1318 21 nt Target: 5'-AUGAGGAGACACCGCCCACCA-3' (SEQ ID NO: 1551)

MYC-1319 21 nt Target: 5'-UGAGGAGACACCGCCCACCAC-3' (SEQ ID NO: 1552)

MYC-1320 21 nt Target: 5'-GAGGAGACACCGCCCACCACC-3' (SEQ ID NO: 1553)

MYC-1321 21 nt Target: 5'-AGGAGACACCGCCCACCACCA-3' (SEQ ID NO: 1554)

MYC-1322 21 nt Target: 5'-GGAGACACCGCCCACCACCAG-3' (SEQ ID NO: 1555)

MYC-1323 21 nt Target: 5'-GAGACACCGCCCACCACCAGC-3' (SEQ ID NO: 1556)

MYC-1324 21 nt Target: 5'-AGACACCGCCCACCACCAGCA-3' (SEQ ID NO: 1557)

MYC-1325 21 nt Target: 5'-GACACCGCCCACCACCAGCAG-3' (SEQ ID NO: 1558)

MYC-1326 21 nt Target: 5'-ACACCGCCCACCACCAGCAGC-3' (SEQ ID NO: 1559)

MYC-1327 21 nt Target: 5'-CACCGCCCACCACCAGCAGCG-3' (SEQ ID NO: 1560)

MYC-1328 21 nt Target: 5'-ACCGCCCACCACCAGCAGCGA-3' (SEQ ID NO: 1561)

MYC-1329 21 nt Target: 5'-CCGCCCACCACCAGCAGCGAC-3' (SEQ ID NO: 1562)

MYC-1330 21 nt Target: 5'-CGCCCACCACCAGCAGCGACU-3' (SEQ ID NO: 1563)

MYC-1331 21 nt Target: 5'-GCCCACCACCAGCAGCGACUC-3' (SEQ ID NO: 1564)

MYC-1332 21 nt Target: 5'-CCCACCACCAGCAGCGACUCU-3' (SEQ ID NO: 1565)

MYC-1333 21 nt Target: 5'-CCACCACCAGCAGCGACUCUG-3' (SEQ ID NO: 1566)

MYC-1334 21 nt Target: 5'-CACCACCAGCAGCGACUCUGA-3' (SEQ ID NO: 1567)

MYC-1360 21 nt Target: 5'-AACAAGAAGAUGAGGAAGAAA-3' (SEQ ID NO: 1568)

MYC-1361 21 nt Target: 5'-ACAAGAAGAUGAGGAAGAAAU-3' (SEQ ID NO: 1569)

MYC-1448 21 nt Target: 5'-UGGAGGCCACAGCAAACCUCC-3' (SEQ ID NO: 1570)

MYC-1468 21 nt Target: 5'-CUCACAGCCCACUGGUCCUCA-3' (SEQ ID NO: 1571)

MYC-1469 21 nt Target: 5'-UCACAGCCCACUGGUCCUCAA-3' (SEQ ID NO: 1572)

MYC-1470 21 nt Target: 5'-CACAGCCCACUGGUCCUCAAG-3' (SEQ ID NO: 1573)

MYC-1471 21 nt Target: 5'-ACAGCCCACUGGUCCUCAAGA-3' (SEQ ID NO: 1574)

MYC-1472 21 nt Target: 5'-CAGCCCACUGGUCCUCAAGAG-3' (SEQ ID NO: 1575)

TABLE 5-continued

DsiRNA Target Sequences (21mers) In MYC mRNA

MYC-1473 21 nt Target: 5'-AGCCCACUGGUCCUCAAGAGG-3' (SEQ ID NO: 1576)

MYC-1474 21 nt Target: 5'-GCCCACUGGUCCUCAAGAGGU-3' (SEQ ID NO: 1577)

MYC-1475 21 nt Target: 5'-CCCACUGGUCCUCAAGAGGUG-3' (SEQ ID NO: 1578)

MYC-1476 21 nt Target: 5'-CCACUGGUCCUCAAGAGGUGC-3' (SEQ ID NO: 1579)

MYC-1477 21 nt Target: 5'-CACUGGUCCUCAAGAGGUGCC-3' (SEQ ID NO: 1580)

MYC-1478 21 nt Target: 5'-ACUGGUCCUCAAGAGGUGCCA-3' (SEQ ID NO: 1581)

MYC-1479 21 nt Target: 5'-CUGGUCCUCAAGAGGUGCCAC-3' (SEQ ID NO: 1582)

MYC-1480 21 nt Target: 5'-UGGUCCUCAAGAGGUGCCACG-3' (SEQ ID NO: 1583)

MYC-1481 21 nt Target: 5'-GGUCCUCAAGAGGUGCCACGU-3' (SEQ ID NO: 1584)

MYC-1482 21 nt Target: 5'-GUCCUCAAGAGGUGCCACGUC-3' (SEQ ID NO: 1585)

MYC-1483 21 nt Target: 5'-UCCUCAAGAGGUGCCACGUCU-3' (SEQ ID NO: 1586)

MYC-1711 21 nt Target: 5'-GGAGCUUUUUGCCCUGCGUG-3' (SEQ ID NO: 1587)

MYC-1712 21 nt Target: 5'-GAGCUUUUUGCCCUGCGUGA-3' (SEQ ID NO: 1588)

MYC-1713 21 nt Target: 5'-AGCUUUUUGCCCUGCGUGAC-3' (SEQ ID NO: 1589)

MYC-1714 21 nt Target: 5'-GCUUUUUGCCCUGCGUGACC-3' (SEQ ID NO: 1590)

MYC-1715 21 nt Target: 5'-CUUUUUGCCCUGCGUGACCA-3' (SEQ ID NO: 1591)

MYC-1716 21 nt Target: 5'-UUUUUGCCCUGCGUGACCAG-3' (SEQ ID NO: 1592)

MYC-1717 21 nt Target: 5'-UUUUGCCCUGCGUGACCAGA-3' (SEQ ID NO: 1593)

MYC-1718 21 nt Target: 5'-UUUGCCCUGCGUGACCAGAU-3' (SEQ ID NO: 1594)

MYC-1719 21 nt Target: 5'-UUGCCCUGCGUGACCAGAUC-3' (SEQ ID NO: 1595)

MYC-1720 21 nt Target: 5'-UGCCCUGCGUGACCAGAUCC-3' (SEQ ID NO: 1596)

MYC-1721 21 nt Target: 5'-UGCCCUGCGUGACCAGAUCCC-3' (SEQ ID NO: 1597)

MYC-1856 21 nt Target: 5'-GCGGAAACGACGAGAACAGUU-3' (SEQ ID NO: 1598)

MYC-1857 21 nt Target: 5'-CGGAAACGACGAGAACAGUUG-3' (SEQ ID NO: 1599)

MYC-2115 21 nt Target: 5'-UCUUUAACAGAUUUGUAUUUA-3' (SEQ ID NO: 1600)

MYC-2116 21 nt Target: 5'-CUUUAACAGAUUUGUAUUUAA-3' (SEQ ID NO: 1601)

MYC-2193 21 nt Target: 5'-UUAAAUGUAAAUAACUUUAAU-3' (SEQ ID NO: 1602)

MYC-2194 21 nt Target: 5'-UAAAUGUAAAUAACUUUAAUA-3' (SEQ ID NO: 1603)

MYC-2195 21 nt Target: 5'-AAAUGUAAAUAACUUUAAUAA-3' (SEQ ID NO: 1604)

MYC-2196 21 nt Target: 5'-AAUGUAAAUAACUUUAAUAAA-3' (SEQ ID NO: 1605)

MYC-2197 21 nt Target: 5'-AUGUAAAUAACUUUAAUAAAA-3' (SEQ ID NO: 1606)

MYC-2198 21 nt Target: 5'-UGUAAAUAACUUUAAUAAAAC-3' (SEQ ID NO: 1607)

MYC-2199 21 nt Target: 5'-GUAAAUAACUUUAAUAAAACG-3' (SEQ ID NO: 1608)

MYC-2200 21 nt Target: 5'-UAAAUAACUUUAAUAAAACGU-3' (SEQ ID NO: 1609)

MYC-2201 21 nt Target: 5'-AAAUAACUUUAAUAAAACGUU-3' (SEQ ID NO: 1610)

MYC-2202 21 nt Target: 5'-AAUAACUUUAAUAAAACGUUU-3' (SEQ ID NO: 1611)

MYC-2203 21 nt Target: 5'-AUAACUUUAAUAAAACGUUUA-3' (SEQ ID NO: 1612)

MYC-2204 21 nt Target: 5'-UAACUUUAAUAAAACGUUUAU-3' (SEQ ID NO: 1613)

MYC-2205 21 nt Target: 5'-AACUUUAAUAAAACGUUUAUA-3' (SEQ ID NO: 1614)

TABLE 5-continued

DsiRNA Target Sequences (21mers) In MYC mRNA

MYC-2313 21 nt Target: 5'-GCUUUUUAAAGUUGAUUUUUUU-3' (SEQ ID NO: 1615)

MYC-2314 21 nt Target: 5'-CUUUUUAAAGUUGAUUUUUUU-3' (SEQ ID NO: 1616)

MYC-2315 21 nt Target: 5'-UUUUUAAAGUUGAUUUUUUUC-3' (SEQ ID NO: 1617)

MYC-2316 21 nt Target: 5'-UUUUAAAGUUGAUUUUUUUCU-3' (SEQ ID NO: 1618)

MYC-2317 21 nt Target: 5'-UUUAAAGUUGAUUUUUUUCUA-3' (SEQ ID NO: 1619)

MYC-2318 21 nt Target: 5'-UUAAAGUUGAUUUUUUUCUAU-3' (SEQ ID NO: 1620)

MYC-2319 21 nt Target: 5'-UAAAGUUGAUUUUUUUCUAUU-3' (SEQ ID NO: 1621)

MYC-2320 21 nt Target: 5'-AAAGUUGAUUUUUUUCUAUUG-3' (SEQ ID NO: 1622)

MYC-2321 21 nt Target: 5'-AAGUUGAUUUUUUUCUAUUGU-3' (SEQ ID NO: 1623)

MYC-2322 21 nt Target: 5'-AGUUGAUUUUUUUCUAUUGUU-3' (SEQ ID NO: 1624)

MYC-2323 21 nt Target: 5'-GUUGAUUUUUUUCUAUUGUUU-3' (SEQ ID NO: 1625)

MYC-2324 21 nt Target: 5'-UUGAUUUUUUUCUAUUGUUUU-3' (SEQ ID NO: 1626)

MYC-2325 21 nt Target: 5'-UGAUUUUUUUCUAUUGUUUUU-3' (SEQ ID NO: 1627)

MYC-2326 21 nt Target: 5'-GAUUUUUUUCUAUUGUUUUUA-3' (SEQ ID NO: 1628)

MYC-2327 21 nt Target: 5'-AUUUUUUUCUAUUGUUUUUAG-3' (SEQ ID NO: 1629)

MYC-2328 21 nt Target: 5'-UUUUUUUCUAUUGUUUUUAGA-3' (SEQ ID NO: 1630)

MYC-2329 21 nt Target: 5'-UUUUUUCUAUUGUUUUUAGAA-3' (SEQ ID NO: 1631)

MYC-2330 21 nt Target: 5'-UUUUUCUAUUGUUUUUAGAAA-3' (SEQ ID NO: 1632)

MYC-2331 21 nt Target: 5'-UUUUCUAUUGUUUUUAGAAAA-3' (SEQ ID NO: 1633)

MYC-2332 21 nt Target: 5'-UUUCUAUUGUUUUUAGAAAAA-3' (SEQ ID NO: 1634)

MYC-2333 21 nt Target: 5'-UUCUAUUGUUUUUAGAAAAAA-3' (SEQ ID NO: 1635)

TABLE 6

Selected Human Anti-MYC "Blunt/Fray" DsiRNAs

5'-CUCGAGAAGGGCAGGGCUUCUCAGA$A^{A-3'}$ (SEQ ID NO: 1636)
3'-GAGCUCUUCCCGUCCCGAAGAGUCU$_{C}{}_{C-5'}$ (SEQ ID NO: 328)

MYC-94 Target: 5'-CTCGAGAAGGGCAGGGCTTCTCAGAGG-3' (SEQ ID NO: 655)

5'-GGGCUUUAUCUAACUCGCUGUAGUA$^{C}{}^{C-3'}$ (SEQ ID NO: 1637)
3'-CCCGAAAUAGAUUGAGCGACAUCAU$_{U}{}_{A-5'}$ (SEQ ID NO: 329)

MYC-178 Target: 5'-GGGCTTTATCTAACTCGCTGTAGTAAT-3' (SEQ ID NO: 656)

5'-AACCCUUGCCGCAUCCACGAAACUU$C^{A-3'}$ (SEQ ID NO: 1638)
3'-UUGGGAACGGCGUAGGUGCUUUGAA$_{A}{}_{C-5'}$ (SEQ ID NO: 330)

MYC-365 Target: 5'-AACCCTTGCCGCATCCACGAAACTTTG-3' (SEQ ID NO: 657)

5'-UUGCCGCAUCCACGAAACUUUGCCC$^{C}{}^{C-3'}$ (SEQ ID NO: 1639)
3'-AACGGCGUAGGUGCUUUGAAACGGG$_{U}{}_{A-5'}$ (SEQ ID NO: 331)

MYC-370 Target: 5'-TTGCCGCATCCACGAAACTTTGCCCAT-3' (SEQ ID NO: 658)

TABLE 6-continued

Selected Human Anti-MYC "Blunt/Fray" DsiRNAs

```
              5'-CAUCCACGAAACUUUGCCCAUAGCA A A-3'   (SEQ ID NO: 1640)
              3'-GUAGGUGCUUUGAAACGGGUAUCGU C G-5'   (SEQ ID NO: 332)

MYC-376 Target: 5'-CATCCACGAAACTTTGCCCATAGCAGC-3'   (SEQ ID NO: 659)

5'-GGGCGGGCACUUUGCACUGGAACUU C A-3'   (SEQ ID NO: 1641)
              3'-CCCGCCCGUGAAACGUGACCUUGAA U G-5'   (SEQ ID NO: 333)

MYC-403 Target: 5'-GGGCGGGCACTTTGCACTGGAACTTAC-3'  (SEQ ID NO: 660)

5'-GCACUUUGCACUGGAACUUACAACA A A-3'   (SEQ ID NO: 1642)
              3'-CGUGAAACGUGACCUUGAAUGUUGU G G-5'   (SEQ ID NO: 334)

MYC-409 Target: 5'-GCACTTTGCACTGGAACTTACAACACC-3'  (SEQ ID NO: 661)

5'-CACUGGAACUUACAACACCCGAGCA C A-3'   (SEQ ID NO: 1643)
              3'-GUGACCUUGAAUGUUGUGGGCUCGU U C-5'   (SEQ ID NO: 335)

MYC-417 Target: 5'-CACTGGAACTTACAACACCCGAGCAAG-3'  (SEQ ID NO: 662)

5'-UUGCAGCUGCUUAGACGCUGGAUUU C C-3'   (SEQ ID NO: 1644)
              3'-AACGUCGACGAAUCUGCGACCUAAA A A-5'   (SEQ ID NO: 336)

MYC-535 Target: 5'-TTGCAGCTGCTTAGACGCTGGATTTTT-3'  (SEQ ID NO: 663)

5'-CUGCUUAGACGCUGGAUUUUUUUCG A A-3'   (SEQ ID NO: 1645)
              3'-GACGAAUCUGCGACCUAAAAAAAGC C C-5'   (SEQ ID NO: 337)

MYC-541 Target: 5'-CTGCTTAGACGCTGGATTTTTTCGGG-3'   (SEQ ID NO: 664)

5'-GACGCUGGAUUUUUUCGGGUAGUG A C-3'    (SEQ ID NO: 1646)
              3'-CUGCGACCUAAAAAAAGCCCAUCAC C U-5'   (SEQ ID NO: 338)

MYC-548 Target: 5'-GACGCTGGATTTTTTCGGGTAGTGGA-3'   (SEQ ID NO: 665)

5'-UGGAUUUUUUCGGGUAGUGGAAAA A A-3'    (SEQ ID NO: 1647)
              3'-ACCUAAAAAAAGCCCAUCACCUUUU G G-5'   (SEQ ID NO: 339)

MYC-553 Target: 5'-TGGATTTTTTCGGGTAGTGGAAAACC-3'   (SEQ ID NO: 666)

5'-UUCGGGUAGUGGAAAACCAGCAGCC C A-3'   (SEQ ID NO: 1648)
              3'-AAGCCCAUCACCUUUUGGUCGUCGG A G-5'   (SEQ ID NO: 340)

MYC-562 Target: 5'-TTCGGGTAGTGGAAAACCAGCAGCCTC-3'  (SEQ ID NO: 667)

5'-CCCUCAACGUUAGCUUCACCAACAG A C-3'   (SEQ ID NO: 1649)
              3'-GGGAGUUGCAAUCGAAGUGGUUGUC C U-5'   (SEQ ID NO: 341)

MYC-601 Target: 5'-CCCTCAACGTTAGCTTCACCAACAGGA-3'  (SEQ ID NO: 668)

5'-ACGUUAGCUUCACCAACAGGAACUA C A-3'   (SEQ ID NO: 1650)
              3'-UGCAAUCGAAGUGGUUGUCCUUGAU A C-5'   (SEQ ID NO: 342)

MYC-607 Target: 5'-ACGTTAGCTTCACCAACAGGAACTATG-3'  (SEQ ID NO: 669)
```

TABLE 6-continued

Selected Human Anti-MYC "Blunt/Fray" DsiRNAs

```
            5'-ACGACUCGGUGCAGCCGUAUUUCUA A C-3'      (SEQ ID NO: 1651)
            3'-UGCUGAGCCACGUCGGCAUAAAGAU G A-5'     (SEQ ID NO: 343)
```

MYC-643 Target: 5'-ACGACTCGGTGCAGCCGTATTTCTACT-3' (SEQ ID NO: 670)

```
            5'-GUGCAGCCGUAUUUCUACUGCGACG C A-3'     (SEQ ID NO: 1652)
            3'-CACGUCGGCAUAAAGAUGACGCUGC U C-5'     (SEQ ID NO: 344)
```

MYC-651 Target: 5'-GTGCAGCCGTATTTCTACTGCGACGAG-3' (SEQ ID NO: 671)

```
            5'-AGGAGGAGAACUUCUACCAGCAGCA A A-3'     (SEQ ID NO: 1653)
            3'-UCCUCCUCUUGAAGAUGGUCGUCGU C G-5'     (SEQ ID NO: 345)
```

MYC-676 Target: 5'-AGGAGGAGAACTTCTACCAGCAGC-3' (SEQ ID NO: 672)

```
            5'-CAGCGAGGAUAUCUGGAAGAAAUUC A C-3'     (SEQ ID NO: 1654)
            3'-GUCGCUCCUAUAGACCUUCUUUAAG C U-5'     (SEQ ID NO: 346)
```

MYC-731 Target: 5'-CAGCGAGGATATCTGGAAGAAATTCGA-3' (SEQ ID NO: 673)

```
            5'-UACGUUGCGGUCACACCCUUCUCCC C C-3'     (SEQ ID NO: 1655)
            3'-AUGCAACGCCAGUGUGGGAAGAGGG A A-5'     (SEQ ID NO: 347)
```

MYC-816 Target: 5'-TACGTTGCGGTCACACCCTTCTCCTT-3' (SEQ ID NO: 674)

```
            5'-AGACAUGGUGAACCAGAGUUUCAUC C A-3'     (SEQ ID NO: 1656)
            3'-UCUGUACCACUUGGUCUCAAAGUAG A C-5'     (SEQ ID NO: 348)
```

MYC-920 Target: 5'-AGACATGGTGAACCAGAGTTTCATCTG-3' (SEQ ID NO: 675)

```
            5'-ACCCGGACGACGAGACCUUCAUCAA C A-3'     (SEQ ID NO: 1657)
            3'-UGGGCCUGCUGCUCUGGAAGUAGUU U U-5'     (SEQ ID NO: 349)
```

MYC-949 Target: 5'-ACCCGGACGACGAGACCTTCATCAAAA-3' (SEQ ID NO: 676)

```
            5'-ACGAGACCUUCAUCAAAAACAUCAU A C-3'     (SEQ ID NO: 1658)
            3'-UGCUCUGGAAGUAGUUUUUGUAGUA G U-5'     (SEQ ID NO: 350)
```

MYC-958 Target: 5'-ACGAGACCTTCATCAAAAACATCATCA-3' (SEQ ID NO: 677)

```
            5'-UCAAAAACAUCAUCAUCCAGGACUG C C-3'     (SEQ ID NO: 1659)
            3'-AGUUUUUGUAGUAGUAGGUCCUGAC A U-5'     (SEQ ID NO: 351)
```

MYC-970 Target: 5'-TCAAAAACATCATCATCCAGGACTGTA-3' (SEQ ID NO: 678)

```
            5'-CAGGACUGUAUGUGGAGCGGCUUCU A A-3'     (SEQ ID NO: 1660)
            3'-GUCCUGACAUACACCUCGCCGAAGA G C-5'     (SEQ ID NO: 352)
```

MYC-987 Target: 5'-CAGGACTGTATGTGGAGCGGCTTCTCG-3' (SEQ ID NO: 679)

```
            5'-GUCUGCUCCACCUCCAGCUUGUACC C A-3'     (SEQ ID NO: 1661)
            3'-CAGACGAGGUGGAGGUCGAACAUGG A C-5'     (SEQ ID NO: 353)
```

MYC-1104 Target: 5'-GTCTGCTCCACCTCCAGCTTGTACCTG-3' (SEQ ID NO: 680)

TABLE 6-continued

Selected Human Anti-MYC "Blunt/Fray" DsiRNAs

```
               5'-CCACCUCCAGCUUGUACCUGCAGGA C^A-3'    (SEQ ID NO: 1662)
               3'-GGUGGAGGUCGAACAUGGACGUCCU _A_G-5'   (SEQ ID NO: 354)
```

MYC-1111 Target: 5'-CCACCTCCAGCTTGTACCTGCAGGATC-3'  (SEQ ID NO: 681)

```
               5'-UCCAGCUUGUACCUGCAGGAUCUGA A^A-3'    (SEQ ID NO: 1663)
               3'-AGGUCGAACAUGGACGUCCUAGACU _C_G-5'   (SEQ ID NO: 355)
```

MYC-1116 Target: 5'-TCCAGCTTGTACCTGCAGGATCTGAGC-3'  (SEQ ID NO: 682)

```
               5'-CCAAGUCCUGCGCCUCGCAAGACUC A^C-3'    (SEQ ID NO: 1664)
               3'-GGUUCAGGACGCGGAGCGUUCUGAG _G_U-5'   (SEQ ID NO: 356)
```

MYC-1210 Target: 5'-CCAAGTCCTGCGCCTCGCAAGACTCCA-3'  (SEQ ID NO: 683)

```
               5'-CAGCAGCGACUCUGAGGAGGAACAA A^C-3'    (SEQ ID NO: 1665)
               3'-GUCGUCGCUGAGACUCCUCCUUGUU _C_U-5'   (SEQ ID NO: 357)
```

MYC-1340 Target: 5'-CAGCAGCGACTCTGAGGAGGAACAAGA-3'  (SEQ ID NO: 684)

```
               5'-CGACUCUGAGGAGGAACAAGAAGAU A^C-3'    (SEQ ID NO: 1666)
               3'-GCUGAGACUCCUCCUUGUUCUUCUA _C_U-5'   (SEQ ID NO: 358)
```

MYC-1346 Target: 5'-CGACTCTGAGGAGGAACAAGAAGATGA-3'  (SEQ ID NO: 685)

```
               5'-CUGAGGAGGAACAAGAAGAUGAGGA C^A-3'    (SEQ ID NO: 1667)
               3'-GACUCCUCCUUGUUCUUCUACUCCU _U_C-5'   (SEQ ID NO: 359)
```

MYC-1351 Target: 5'-CTGAGGAGGAACAAGAAGATGAGGAAG-3'  (SEQ ID NO: 686)

```
               5'-GGAACAAGAAGAUGAGGAAGAAAUC A^C-3'    (SEQ ID NO: 1668)
               3'-CCUUGUUCUUCUACUCCUUCUUUAG _C_U-5'   (SEQ ID NO: 360)
```

MYC-1358 Target: 5'-GGAACAAGAAGATGAGGAAGAAATCGA-3'  (SEQ ID NO: 687)

```
               5'-AGAAGAUGAGGAAGAAAUCGAUGUU A^C-3'    (SEQ ID NO: 1669)
               3'-UCUUCUACUCCUUCUUUAGCUACAA _C_A-5'   (SEQ ID NO: 361)
```

MYC-1364 Target: 5'-AGAAGATGAGGAAGAAATCGATGTTGT-3'  (SEQ ID NO: 688)

```
               5'-UGAGGAAGAAAUCGAUGUUGUUUCU A^C-3'    (SEQ ID NO: 1670)
               3'-ACUCCUUCUUUAGCUACAACAAAGA _C_A-5'   (SEQ ID NO: 362)
```

MYC-1370 Target: 5'-TGAGGAAGAAATCGATGTTGTTTCTGT-3'  (SEQ ID NO: 689)

```
               5'-AGAAAUCGAUGUUGUUUCUGUGGAA C^C-3'    (SEQ ID NO: 1671)
               3'-UCUUUAGCUACAACAAAGACACCUU _U_U-5'   (SEQ ID NO: 363)
```

MYC-1376 Target: 5'-AGAAATCGATGTTGTTTCTGTGGAAAA-3'  (SEQ ID NO: 690)

```
               5'-CGAUGUUGUUUCUGUGGAAAAGAGG A^C-3'    (SEQ ID NO: 1672)
               3'-GCUACAACAAAGACACCUUUUCUCC _G_U-5'   (SEQ ID NO: 364)
```

MYC-1382 Target: 5'-CGATGTTGTTTCTGTGGAAAAGAGGCA-3'  (SEQ ID NO: 691)

TABLE 6-continued

Selected Human Anti-MYC "Blunt/Fray" DsiRNAs

```
              5'-AAGAGGCAGGCUCCUGGCAAAAGGU^A^C-3'   (SEQ ID NO: 1673)
              3'-UUCUCCGUCCGAGGACCGUUUUCCA_G_U-5'  (SEQ ID NO: 365)
```

MYC-1401 Target: 5'-AAGAGGCAGGCTCCTGGCAAAAGGTCA-3' (SEQ ID NO: 692)

```
              5'-GCAGGCUCCUGGCAAAAGGUCAGAG^C^A-3'   (SEQ ID NO: 1674)
              3'-CGUCCGAGGACCGUUUUCCAGUCUC_A_G-5'  (SEQ ID NO: 366)
```

MYC-1406 Target: 5'-GCAGGCTCCTGGCAAAAGGTCAGAGTC-3' (SEQ ID NO: 693)

```
              5'-CUCCUGGCAAAAGGUCAGAGUCUGG^C^C-3'   (SEQ ID NO: 1675)
              3'-GAGGACCGUUUUCCAGUCUCAGACC_U_A-5'  (SEQ ID NO: 367)
```

MYC-1411 Target: 5'-CTCCTGGCAAAAGGTCAGAGTCTGGAT-3' (SEQ ID NO: 694)

```
              5'-GGCAAAAGGUCAGAGUCUGGAUCAC^A^C-3'   (SEQ ID NO: 1676)
              3'-CCGUUUUCCAGUCUCAGACCUAGUG_G_A-5'  (SEQ ID NO: 368)
```

MYC-1416 Target: 5'-GGCAAAAGGTCAGAGTCTGGATCACCT-3' (SEQ ID NO: 695)

```
              5'-AAGGUCAGAGUCUGGAUCACCUUCU^A^A-3'   (SEQ ID NO: 1677)
              3'-UUCCAGUCUCAGACCUAGUGGAAGA_C_G-5'  (SEQ ID NO: 369)
```

MYC-1421 Target: 5'-AAGGTCAGAGTCTGGATCACCTTCTGC-3' (SEQ ID NO: 696)

```
              5'-CAGCAAACCUCCUCACAGCCCACUG^A^C-3'   (SEQ ID NO: 1678)
              3'-GUCGUUUGGAGGAGUGUCGGGUGAC_C_A-5'  (SEQ ID NO: 370)
```

MYC-1457 Target: 5'-CAGCAAACCTCCTCACAGCCCACTGGT-3' (SEQ ID NO: 697)

```
              5'-CUCCUCACAGCCCACUGGUCCUCAA^A^C-3'   (SEQ ID NO: 1679)
              3'-GAGGAGUGUCGGGUGACCAGGAGUU_C_U-5'  (SEQ ID NO: 371)
```

MYC-1465 Target: 5'-CTCCTCACAGCCCACTGGTCCTCAAGA-3' (SEQ ID NO: 698)

```
              5'-CUCCCUCCACUCGGAAGGACUAUCC^C^A-3'   (SEQ ID NO: 1680)
              3'-GAGGGAGGUGAGCCUUCCUGAUAGG_A_C-5'  (SEQ ID NO: 372)
```

MYC-1531 Target: 5'-CTCCCTCCACTCGGAAGGACTATCCTG-3' (SEQ ID NO: 699)

```
              5'-CACUCGGAAGGACUAUCCUGCUGCC^C^C-3'   (SEQ ID NO: 1681)
              3'-GUGAGCCUUCCUGAUAGGACGACGG_U_U-5'  (SEQ ID NO: 373)
```

MYC-1538 Target: 5'-CACTCGGAAGGACTATCCTGCTGCCAA-3' (SEQ ID NO: 700)

```
              5'-CUAUCCUGCUGCCAAGAGGGUCAAG^C^C-3'   (SEQ ID NO: 1682)
              3'-GAUAGGACGACGGUUCUCCCAGUUC_A_A-5'  (SEQ ID NO: 374)
```

MYC-1550 Target: 5'-CTATCCTGCTGCCAAGAGGGTCAAGTT-3' (SEQ ID NO: 701)

```
              5'-CUGCUGCCAAGAGGGUCAAGUUGGA^A^C-3'   (SEQ ID NO: 1683)
              3'-GACGACGGUUCUCCCAGUUCAACCU_G_U-5'  (SEQ ID NO: 375)
```

MYC-1555 Target: 5'-CTGCTGCCAAGAGGGTCAAGTTGGACA-3' (SEQ ID NO: 702)

TABLE 6-continued

Selected Human Anti-MYC "Blunt/Fray" DsiRNAs

```
              5'-GCCAAGAGGGUCAAGUUGGACAGUG^(C A)-3'      (SEQ ID NO: 1684)
              3'-CGGUUCUCCCAGUUCAACCUGUCAC_(A G)-5'     (SEQ ID NO: 376)
```

MYC-1560 Target: 5'-GCCAAGAGGGTCAAGTTGGACAGTGTC-3' (SEQ ID NO: 703)

```
              5'-GAGGGUCAAGUUGGACAGUGUCAGA^(A C)-3'     (SEQ ID NO: 1685)
              3'-CUCCCAGUUCAACCUGUCACAGUCU_(C A)-5'    (SEQ ID NO: 377)
```

MYC-1565 Target: 5'-GAGGGTCAAGTTGGACAGTGTCAGAGT-3' (SEQ ID NO: 704)

```
              5'-UCAAGUUGGACAGUGUCAGAGUCCU^(A C)-3'    (SEQ ID NO: 1686)
              3'-AGUUCAACCUGUCACAGUCUCAGGA_(C U)-5'   (SEQ ID NO: 378)
```

MYC-1570 Target: 5'-TCAAGTTGGACAGTGTCAGAGTCCTGA-3' (SEQ ID NO: 705)

```
              5'-UUGGACAGUGUCAGAGUCCUGAGAC^(C A)-3'    (SEQ ID NO: 1687)
              3'-AACCUGUCACAGUCUCAGGACUCUG_(U C)-5'   (SEQ ID NO: 379)
```

MYC-1575 Target: 5'-TTGGACAGTGTCAGAGTCCTGAGACAG-3' (SEQ ID NO: 706)

```
              5'-GUCAGAGUCCUGAGACAGAUCAGCA^(C A)-3'    (SEQ ID NO: 1688)
              3'-CAGUCUCAGGACUCUGUCUAGUCGU_(U G)-5'   (SEQ ID NO: 380)
```

MYC-1584 Target: 5'-GTCAGAGTCCTGAGACAGATCAGCAAC-3' (SEQ ID NO: 707)

```
              5'-CUGAGACAGAUCAGCAACAACCGAA^(C C)-3'    (SEQ ID NO: 1689)
              3'-GACUCUGUCUAGUCGUUGUUGGCUU_(U U)-5'   (SEQ ID NO: 381)
```

MYC-1593 Target: 5'-CTGAGACAGATCAGCAACAACCGAAAA-3' (SEQ ID NO: 708)

```
              5'-CAGAUCAGCAACAACCGAAAAUGCA^(A A)-3'    (SEQ ID NO: 1690)
              3'-GUCUAGUCGUUGUUGGCUUUUACGU_(G G)-5'   (SEQ ID NO: 382)
```

MYC-1599 Target: 5'-CAGATCAGCAACAACCGAAAATGCACC-3' (SEQ ID NO: 709)

```
              5'-GUCCUCGGACACCGAGGAGAAUGUC^(C C)-3'    (SEQ ID NO: 1691)
              3'-CAGGAGCCUGUGGCUCCUCUUACAG_(U U)-5'   (SEQ ID NO: 383)
```

MYC-1634 Target: 5'-GTCCTCGGACACCGAGGAGAATGTCAA-3' (SEQ ID NO: 710)

```
              5'-CGGACACCGAGGAGAAUGUCAAGAG^(A A)-3'    (SEQ ID NO: 1692)
              3'-GCCUGUGGCUCCUCUUACAGUUCUC_(C G)-5'   (SEQ ID NO: 384)
```

MYC-1639 Target: 5'-CGGACACCGAGGAGAATGTCAAGAGGC-3' (SEQ ID NO: 711)

```
              5'-GCCAGAGGAGGAACGAGCUAAAACG^(A C)-3'    (SEQ ID NO: 1693)
              3'-CGGUCUCCUCCUUGCUCGAUUUUGC_(C U)-5'   (SEQ ID NO: 385)
```

MYC-1687 Target: 5'-GCCAGAGGAGGAACGAGCTAAAACGGA-3' (SEQ ID NO: 712)

```
              5'-GGAGGAACGAGCUAAAACGGAGCUU^(C C)-3'    (SEQ ID NO: 1694)
              3'-CCUCCUUGCUCGAUUUUGCCUCGAA_(A A)-5'   (SEQ ID NO: 386)
```

MYC-1693 Target: 5'-GGAGGAACGAGCTAAAACGGAGCTTTT-3' (SEQ ID NO: 713)

TABLE 6-continued

Selected Human Anti-MYC "Blunt/Fray" DsiRNAs

```
          5'-AACGAGCUAAAACGGAGCUUUUUUG^A A-3'      (SEQ ID NO: 1695)
          3'-UUGCUCGAUUUUGCCUCGAAAAAAC_G G-5'     (SEQ ID NO: 387)

MYC-1698 Target: 5'-AACGAGCTAAAACGGAGCTTTTTTGCC-3'  (SEQ ID NO: 714)

5'-CUAAAACGGAGCUUUUUUGCCCUGC^A C-3'      (SEQ ID NO: 1696)
          3'-GAUUUUGCCUCGAAAAAACGGGACG_C A-5'     (SEQ ID NO: 388)

MYC-1704 Target: 5'-CTAAAACGGAGCTTTTTTGCCCTGCGT-3' (SEQ ID NO: 715)

5'-ACGGAGCUUUUUUGCCCUGCGUGAC^A C-3'     (SEQ ID NO: 1697)
          3'-UGCCUCGAAAAAACGGGACGCACUG_G U-5'     (SEQ ID NO: 389)

MYC-1709 Target: 5'-ACGGAGCTTTTTTGCCCTGCGTGACCA-3' (SEQ ID NO: 716)

5'-GUGACCAGAUCCCGGAGUUGGAAAA^A C-3'      (SEQ ID NO: 1698)
          3'-CACUGGUCUAGGGCCUCAACCUUUU_G U-5'     (SEQ ID NO: 390)

MYC-1729 Target: 5'-GTGACCAGATCCCGGAGTTGGAAAACA-3' (SEQ ID NO: 717)

5'-CAGAUCCCGGAGUUGGAAAACAAUG^C C-3'      (SEQ ID NO: 1699)
          3'-GUCUAGGGCCUCAACCUUUUGUUAC_U U-5'     (SEQ ID NO: 391)

MYC-1734 Target: 5'-CAGATCCCGGAGTTGGAAAACAATGAA-3' (SEQ ID NO: 718)

5'-CCCGGAGUUGGAAAACAAUGAAAAG^A A-3'      (SEQ ID NO: 1700)
          3'-GGGCCUCAACCUUUUGUUACUUUUC_C G-5'     (SEQ ID NO: 392)

MYC-1739 Target: 5'-CCCGGAGTTGGAAAACAATGAAAAGGC-3' (SEQ ID NO: 719)

5'-CAAGGUAGUUAUCCUUAAAAAAGCC^C A-3'      (SEQ ID NO: 1701)
          3'-GUUCCAUCAAUAGGAAUUUUUUCGG_U G-5'     (SEQ ID NO: 393)

MYC-1769 Target: 5'-CAAGGTAGTTATCCTTAAAAAAGCCAC-3' (SEQ ID NO: 720)

5'-UAGUUAUCCUUAAAAAAGCCACAGC^C C-3'      (SEQ ID NO: 1702)
          3'-AUCAAUAGGAAUUUUUUCGGUGUCG_U A-5'     (SEQ ID NO: 394)

MYC-1774 Target: 5'-TAGTTATCCTTAAAAAAGCCACAGCAT-3' (SEQ ID NO: 721)

5'-AUCCUUAAAAAAGCCACAGCAUACA^C A-3'      (SEQ ID NO: 1703)
          3'-UAGGAAUUUUUUCGGUGUCGUAUGU_A G-5'     (SEQ ID NO: 395)

MYC-1779 Target: 5'-ATCCTTAAAAAAGCCACAGCATACATC-3' (SEQ ID NO: 722)

5'-UAAAAAAGCCACAGCAUACAUCCUG^C A-3'      (SEQ ID NO: 1704)
          3'-AUUUUUUCGGUGUCGUAUGUAGGAC_A G-5'     (SEQ ID NO: 396)

MYC-1784 Target: 5'-TAAAAAAGCCACAGCATACATCCTGTC-3' (SEQ ID NO: 723)

5'-AAGCCACAGCAUACAUCCUGUCCGU^A A-3'      (SEQ ID NO: 1705)
          3'-UUCGGUGUCGUAUGUAGGACAGGCA_G G-5'     (SEQ ID NO: 397)

MYC-1789 Target: 5'-AAGCCACAGCATACATCCTGTCCGTCC-3' (SEQ ID NO: 724)
```

TABLE 6-continued

Selected Human Anti-MYC "Blunt/Fray" DsiRNAs

```
            5'-CAGCAUACAUCCUGUCCGUCCAAGC^C^A-3'    (SEQ ID NO: 1706)
            3'-GUCGUAUGUAGGACAGGCAGGUUCG_U_C-5'   (SEQ ID NO: 398)
```

MYC-1795 Target: 5'-CAGCATACATCCTGTCCGTCCAAGCAG-3' (SEQ ID NO: 725)

```
            5'-AUCCUGUCCGUCCAAGCAGAGGAGC^C^C-3'    (SEQ ID NO: 1707)
            3'-UAGGACAGGCAGGUUCGUCUCCUCG_U_U-5'   (SEQ ID NO: 399)
```

MYC-1803 Target: 5'-ATCCTGTCCGTCCAAGCAGAGGAGCAA-3' (SEQ ID NO: 726)

```
            5'-GUCCGUCCAAGCAGAGGAGCAAAAG^A^C-3'    (SEQ ID NO: 1708)
            3'-CAGGCAGGUUCGUCUCCUCGUUUUC_G_A-5'   (SEQ ID NO: 400)
```

MYC-1808 Target: 5'-GTCCGTCCAAGCAGAGGAGCAAAAGCT-3' (SEQ ID NO: 727)

```
            5'-AAGCAGAGGAGCAAAAGCUCAUUUC^C^A-3'    (SEQ ID NO: 1709)
            3'-UUCGUCUCCUCGUUUUCGAGUAAAG_A_C-5'   (SEQ ID NO: 401)
```

MYC-1816 Target: 5'-AAGCAGAGGAGCAAAAGCTCATTTCTG-3' (SEQ ID NO: 728)

```
            5'-GGAGCAAAAGCUCAUUUCUGAAGAG^A^C-3'    (SEQ ID NO: 1710)
            3'-CCUCGUUUUCGAGUAAAGACUUCUC_C_U-5'   (SEQ ID NO: 402)
```

MYC-1823 Target: 5'-GGAGCAAAAGCTCATTTCTGAAGAGGA-3' (SEQ ID NO: 729)

```
            5'-AAAAGCUCAUUUCUGAAGAGGACUU^A^C-3'    (SEQ ID NO: 1711)
            3'-UUUUCGAGUAAAGACUUCUCCUGAA_C_A-5'   (SEQ ID NO: 403)
```

MYC-1828 Target: 5'-AAAAGCTCATTTCTGAAGAGGACTTGT-3' (SEQ ID NO: 730)

```
            5'-UCAUUUCUGAAGAGGACUUGUUGCG^A^C-3'    (SEQ ID NO: 1712)
            3'-AGUAAAGACUUCUCCUGAACAACGC_C_U-5'   (SEQ ID NO: 404)
```

MYC-1834 Target: 5'-TCATTTCTGAAGAGGACTTGTTGCGGA-3' (SEQ ID NO: 731)

```
            5'-CUGAAGAGGACUUGUUGCGGAAACG^C^A-3'    (SEQ ID NO: 1713)
            3'-GACUUCUCCUGAACAACGCCUUUGC_U_G-5'   (SEQ ID NO: 405)
```

MYC-1840 Target: 5'-CTGAAGAGGACTTGTTGCGGAAACGAC-3' (SEQ ID NO: 732)

```
            5'-GAGGACUUGUUGCGGAAACGACGAG^C^C-3'    (SEQ ID NO: 1714)
            3'-CUCCUGAACAACGCCUUUGCUGCUC_U_U-5'   (SEQ ID NO: 406)
```

MYC-1845 Target: 5'-GAGGACTTGTTGCGGAAACGACGAGAA-3' (SEQ ID NO: 733)

```
            5'-CUUGUUGCGGAAACGACGAGAACAG^C^C-3'    (SEQ ID NO: 1715)
            3'-GAACAACGCCUUUGCUGCUCUUGUC_A_A-5'   (SEQ ID NO: 407)
```

MYC-1850 Target: 5'-CTTGTTGCGGAAACGACGAGAACAGTT-3' (SEQ ID NO: 734)

```
            5'-UGCGGAAACGACGAGAACAGUUGAA^C^A-3'    (SEQ ID NO: 1716)
            3'-ACGCCUUUGCUGCUCUUGUCAACUU_U_G-5'   (SEQ ID NO: 408)
```

MYC-1855 Target: 5'-TGCGGAAACGACGAGAACAGTTGAAAC-3' (SEQ ID NO: 735)

TABLE 6-continued

Selected Human Anti-MYC "Blunt/Fray" DsiRNAs

```
                 5'-ACAAACUUGAACAGCUACGGAACUC C C-3'   (SEQ ID NO: 1717)
                 3'-UGUUUGAACUUGUCGAUGCCUUGAG A A-5'   (SEQ ID NO: 409)

MYC-1882 Target: 5'-ACAAACTTGAACAGCTACGGAACTCTT-3'    (SEQ ID NO: 736)

5'-UUGAACAGCUACGGAACUCUUGUGC A C-3'   (SEQ ID NO: 1718)
                 3'-AACUUGUCGAUGCCUUGAGAACACG C A-5'   (SEQ ID NO: 410)

MYC-1888 Target: 5'-TTGAACAGCTACGGAACTCTTGTGCGT-3'    (SEQ ID NO: 737)

5'-CAGCUACGGAACUCUUGUGCGUAAG A C-3'   (SEQ ID NO: 1719)
                 3'-GUCGAUGCCUUGAGAACACGCAUUC C U-5'   (SEQ ID NO: 411)

MYC-1893 Target: 5'-CAGCTACGGAACTCTTGTGCGTAAGGA-3'    (SEQ ID NO: 738)

5'-GGAACUCUUGUGCGUAAGGAAAAGU C C-3'   (SEQ ID NO: 1720)
                 3'-CCUUGAGAACACGCAUUCCUUUUCA U U-5'   (SEQ ID NO: 412)

MYC-1900 Target: 5'-GGAACTCTTGTGCGTAAGGAAAAGTAA-3'    (SEQ ID NO: 739)

5'-CUUGUGCGUAAGGAAAAGUAAGGAA C C-3'   (SEQ ID NO: 1721)
                 3'-GAACACGCAUUCCUUUUCAUUCCUU U U-5'   (SEQ ID NO: 413)

MYC-1906 Target: 5'-CTTGTGCGTAAGGAAAAGTAAGGAAAA-3'    (SEQ ID NO: 740)

5'-GCGUAAGGAAAAGUAAGGAAAACGA C C-3'   (SEQ ID NO: 1722)
                 3'-CGCAUUCCUUUUCAUUCCUUUUGCU A A-5'   (SEQ ID NO: 414)

MYC-1911 Target: 5'-GCGTAAGGAAAAGTAAGGAAAACGATT-3'    (SEQ ID NO: 741)

5'-AAGUAAGGAAAACGAUUCCUUCUAA A C-3'   (SEQ ID NO: 1723)
                 3'-UUCAUUCCUUUUGCUAAGGAAGAUU G U-5'   (SEQ ID NO: 415)

MYC-1921 Target: 5'-AAGTAAGGAAAACGATTCCTTCTAACA-3'    (SEQ ID NO: 742)

5'-AGGAAAACGAUUCCUUCUAACAGAA C C-3'   (SEQ ID NO: 1724)
                 3'-UCCUUUUGCUAAGGAAGAUUGUCUU U A-5'   (SEQ ID NO: 416)

MYC-1926 Target: 5'-AGGAAAACGATTCCTTCTAACAGAAAT-3'    (SEQ ID NO: 743)

5'-AACGAUUCCUUCUAACAGAAAUGUC A C-3'   (SEQ ID NO: 1725)
                 3'-UUGCUAAGGAAGAUUGUCUUUACAG G A-5'   (SEQ ID NO: 417)

MYC-1931 Target: 5'-AACGATTCCTTCTAACAGAAATGTCCT-3'    (SEQ ID NO: 744)

5'-UCCUUCUAACAGAAAUGUCCUGAGC C C-3'   (SEQ ID NO: 1726)
                 3'-AGGAAGAUUGUCUUUACAGGACUCG U U-5'   (SEQ ID NO: 418)

MYC-1937 Target: 5'-TCCTTCTAACAGAAATGTCCTGAGCAA-3'    (SEQ ID NO: 745)

5'-AACAGAAAUGUCCUGAGCAAUCACC C C-3'   (SEQ ID NO: 1727)
                 3'-UUGUCUUUACAGGACUCGUUAGUGG A U-5'   (SEQ ID NO: 419)

MYC-1944 Target: 5'-AACAGAAATGTCCTGAGCAATCACCTA-3'    (SEQ ID NO: 746)
```

TABLE 6-continued

Selected Human Anti-MYC "Blunt/Fray" DsiRNAs

```
              5'-GUCCUGAGCAAUCACCUAUGAACUU A C-3'   (SEQ ID NO: 1728)
              3'-CAGGACUCGUUAGUGGAUACUUGAA C A-5'   (SEQ ID NO: 420)

MYC-1953 Target: 5'-GTCCTGAGCAATCACCTATGAACTTGT-3'  (SEQ ID NO: 747)

5'-AGCAAUCACCUAUGAACUUGUUUCA C C-3'   (SEQ ID NO: 1729)
              3'-UCGUUAGUGGAUACUUGAACAAAGU U U-5'   (SEQ ID NO: 421)

MYC-1959 Target: 5'-AGCAATCACCTATGAACTTGTTTCAAA-3' (SEQ ID NO: 748)

5'-CACCUAUGAACUUGUUUCAAAUGCA C A-3'   (SEQ ID NO: 1730)
              3'-GUGGAUACUUGAACAAAGUUUACGU A C-5'   (SEQ ID NO: 422)

MYC-1965 Target: 5'-CACCTATGAACTTGTTTCAAATGCATG-3' (SEQ ID NO: 749)

5'-AUGAACUUGUUUCAAAUGCAUGAUC C C-3'   (SEQ ID NO: 1731)
              3'-UACUUGAACAAAGUUUACGUACUAG U U-5'   (SEQ ID NO: 423)

MYC-1970 Target: 5'-ATGAACTTGTTTCAAATGCATGATCAA-3' (SEQ ID NO: 750)

5'-UUGUUUCAAAUGCAUGAUCAAAUGC C C-3'   (SEQ ID NO: 1732)
              3'-AACAAAGUUUACGUACUAGUUUACG U U-5'   (SEQ ID NO: 424)

MYC-1976 Target: 5'-TTGTTTCAAATGCATGATCAAATGCAA-3' (SEQ ID NO: 751)

5'-UCAAAUGCAUGAUCAAAUGCAACCU A C-3'   (SEQ ID NO: 1733)
              3'-AGUUUACGUACUAGUUUACGUUGGA G U-5'   (SEQ ID NO: 425)

MYC-1981 Target: 5'-TCAAATGCATGATCAAATGCAACCTCA-3' (SEQ ID NO: 752)

5'-AUGAUCAAAUGCAACCUCACAACCU C A-3'   (SEQ ID NO: 1734)
              3'-UACUAGUUUACGUUGGAGUGUUGGA A C-5'   (SEQ ID NO: 426)

MYC-1989 Target: 5'-ATGATCAAATGCAACCTCACAACCTTG-3' (SEQ ID NO: 753)

5'-CAAAUGCAACCUCACAACCUUGGCU A C-3'   (SEQ ID NO: 1735)
              3'-GUUUACGUUGGAGUGUUGGAACCGA C U-5'   (SEQ ID NO: 427)

MYC-1994 Target: 5'-CAAATGCAACCTCACAACCTTGGCTGA-3' (SEQ ID NO: 754)

5'-AACCUCACAACCUUGGCUGAGUCUU A C-3'   (SEQ ID NO: 1736)
              3'-UUGGAGUGUUGGAACCGACUCAGAA C U-5'   (SEQ ID NO: 428)

MYC-2001 Target: 5'-AACCTCACAACCTTGGCTGAGTCTTGA-3' (SEQ ID NO: 755)

5'-CACAACCUUGGCUGAGUCUUGAGAC C A-3'   (SEQ ID NO: 1737)
              3'-GUGUUGGAACCGACUCAGAACUCUG A C-5'   (SEQ ID NO: 429)

MYC-2006 Target: 5'-CACAACCTTGGCTGAGTCTTGAGACTG-3' (SEQ ID NO: 756)

5'-UUGGCUGAGUCUUGAGACUGAAAGA C C-3'   (SEQ ID NO: 1738)
              3'-AACCGACUCAGAACUCUGACUUUCU A A-5'   (SEQ ID NO: 430)

MYC-2013 Target: 5'-TTGGCTGAGTCTTGAGACTGAAAGATT-3' (SEQ ID NO: 757)
```

TABLE 6-continued

Selected Human Anti-MYC "Blunt/Fray" DsiRNAs

```
                5'-GAGUCUUGAGACUGAAAGAUUUAGC A C-3'   (SEQ ID NO: 1739)
                3'-CUCAGAACUCUGACUUUCUAAAUCG G U-5'   (SEQ ID NO: 431)
```

MYC-2019 Target: 5'-GAGTCTTGAGACTGAAAGATTTAGCCA-3'  (SEQ ID NO: 758)

```
                5'-GAGACUGAAAGAUUUAGCCAUAAUG C C-3'   (SEQ ID NO: 1740)
                3'-CUCUGACUUUCUAAAUCGGUAUUAC A U-5'   (SEQ ID NO: 432)
```

MYC-2026 Target: 5'-GAGACTGAAAGATTTAGCCATAATGTA-3'  (SEQ ID NO: 759)

```
                5'-UGAAAGAUUUAGCCAUAAUGUAAAC C A-3'   (SEQ ID NO: 1741)
                3'-ACUUUCUAAAUCGGUAUUACAUUUG A C-5'   (SEQ ID NO: 433)
```

MYC-2031 Target: 5'-TGAAAGATTTAGCCATAATGTAAACTG-3'  (SEQ ID NO: 760)

```
                5'-UAGCCAUAAUGUAAACUGCCUCAAA C C-3'   (SEQ ID NO: 1742)
                3'-AUCGGUAUUACAUUUGACGGAGUUU A A-5'   (SEQ ID NO: 434)
```

MYC-2040 Target: 5'-TAGCCATAATGTAAACTGCCTCAAATT-3'  (SEQ ID NO: 761)

```
                5'-AUGUAAACUGCCUCAAAUUGGACUU C A-3'   (SEQ ID NO: 1743)
                3'-UACAUUUGACGGAGUUUAACCUGAA A C-5'   (SEQ ID NO: 435)
```

MYC-2048 Target: 5'-ATGTAAACTGCCTCAAATTGGACTTTG-3'  (SEQ ID NO: 762)

```
                5'-ACUGCCUCAAAUUGGACUUUGGGCA C C-3'   (SEQ ID NO: 1744)
                3'-UGACGGAGUUUAACCUGAAACCCGU A U-5'   (SEQ ID NO: 436)
```

MYC-2054 Target: 5'-ACTGCCTCAAATTGGACTTTGGGCATA-3'  (SEQ ID NO: 763)

```
                5'-CUCAAAUUGGACUUUGGGCAUAAAA A C-3'   (SEQ ID NO: 1745)
                3'-GAGUUUAACCUGAAACCCGUAUUUU C U-5'   (SEQ ID NO: 437)
```

MYC-2059 Target: 5'-CTCAAATTGGACTTTGGGCATAAAAGA-3'  (SEQ ID NO: 764)

```
                5'-UGGACUUUGGGCAUAAAAGAACUUU C C-3'   (SEQ ID NO: 1746)
                3'-ACCUGAAACCCGUAUUUUCUUGAAA A A-5'   (SEQ ID NO: 438)
```

MYC-2066 Target: 5'-TGGACTTTGGGCATAAAAGAACTTTTT-3'  (SEQ ID NO: 765)

```
                5'-UGGGCAUAAAAGAACUUUUUUAUGC C C-3'   (SEQ ID NO: 1747)
                3'-ACCCGUAUUUUCUUGAAAAAAUACG A A-5'   (SEQ ID NO: 439)
```

MYC-2073 Target: 5'-TGGGCATAAAAGAACTTTTTTATGCTT-3'  (SEQ ID NO: 766)

```
                5'-AUAAAAGAACUUUUUUAUGCUUACC C C-3'   (SEQ ID NO: 1748)
                3'-UAUUUUCUUGAAAAAAUACGAAUGG U A-5'   (SEQ ID NO: 440)
```

MYC-2078 Target: 5'-ATAAAAGAACTTTTTTATGCTTACCAT-3'  (SEQ ID NO: 767)

```
                5'-AGAACUUUUUUAUGCUUACCAUCUU C C-3'   (SEQ ID NO: 1749)
                3'-UCUUGAAAAAAUACGAAUGGUAGAA A A-5'   (SEQ ID NO: 441)
```

MYC-2083 Target: 5'-AGAACTTTTTTATGCTTACCATCTTTT-3'  (SEQ ID NO: 768)

TABLE 6-continued

Selected Human Anti-MYC "Blunt/Fray" DsiRNAs

```
                 5'-UUUUUAUGCUUACCAUCUUUUUUUU C^C-3'   (SEQ ID NO: 1750)
                 3'-AAAAAUACGAAUGGUAGAAAAAAAA A^A-5'   (SEQ ID NO: 442)

MYC-2089 Target: 5'-TTTTTATGCTTACCATCTTTTTTTTT-3'    (SEQ ID NO: 769)

5'-AUGCUUACCAUCUUUUUUUUUCUU C^C-3'   (SEQ ID NO: 1751)
                 3'-UACGAAUGGUAGAAAAAAAAAGAA A^U-5'   (SEQ ID NO: 443)

MYC-2094 Target: 5'-ATGCTTACCATCTTTTTTTTTCTTTA-3'   (SEQ ID NO: 770)

5'-UACCAUCUUUUUUUUUCUUUAACA A^C-3'   (SEQ ID NO: 1752)
                 3'-AUGGUAGAAAAAAAAAGAAAUUGU C^U-5'   (SEQ ID NO: 444)

MYC-2099 Target: 5'-TACCATCTTTTTTTTTCTTTAACAGA-3'   (SEQ ID NO: 771)

5'-CUUUUUUUUUCUUUAACAGAUUUG C^C-3'   (SEQ ID NO: 1753)
                 3'-GAAAAAAAAAGAAAUUGUCUAAAC A^U-5'   (SEQ ID NO: 445)

MYC-2105 Target: 5'-CTTTTTTTTTCTTTAACAGATTTGTA-3'   (SEQ ID NO: 772)

5'-UUCUUUAACAGAUUUGUAUUUAAGA C^C-3'   (SEQ ID NO: 1754)
                 3'-AAGAAAUUGUCUAAACAUAAAUUCU U^A-5'   (SEQ ID NO: 446)

MYC-2114 Target: 5'-TTCTTTAACAGATTTGTATTTAAGAAT-3'   (SEQ ID NO: 773)

5'-AACAGAUUUGUAUUUAAGAAUUGUU C^C-3'   (SEQ ID NO: 1755)
                 3'-UUGUCUAAACAUAAAUUCUUAACAA A^A-5'   (SEQ ID NO: 447)

MYC-2120 Target: 5'-AACAGATTTGTATTTAAGAATTGTTTT-3'   (SEQ ID NO: 774)

5'-UGUAUUUAAGAAUUGUUUUAAAAA C^C-3'   (SEQ ID NO: 1756)
                 3'-ACAUAAAUUCUUAACAAAAUUUUU U^A-5'   (SEQ ID NO: 448)

MYC-2128 Target: 5'-TGTATTTAAGAATTGTTTTAAAAAAT-3'   (SEQ ID NO: 775)

5'-AAGAAUUGUUUUAAAAAAUUUUAA A^C-3'   (SEQ ID NO: 1757)
                 3'-UUCUUAACAAAAUUUUUUAAAAUU C^U-5'   (SEQ ID NO: 449)

MYC-2135 Target: 5'-AAGAATTGTTTTAAAAAATTTTAAGA-3'   (SEQ ID NO: 776)

5'-ACAAUGUUUCUCUGUAAAUAUUGCC C^C-3'   (SEQ ID NO: 1758)
                 3'-UGUUACAAAGAGACAUUUAUAACGG U^A-5'   (SEQ ID NO: 450)

MYC-2167 Target: 5'-ACAATGTTTCTCTGTAAATATTGCCAT-3'   (SEQ ID NO: 777)

5'-CUCUGUAAAUAUUGCCAUUAAAUGU C^C-3'   (SEQ ID NO: 1759)
                 3'-GAGACAUUUAUAACGGUAAUUUACA U^U-5'   (SEQ ID NO: 451)

MYC-2176 Target: 5'-CTCTGTAAATATTGCCATTAAATGTAA-3'   (SEQ ID NO: 778)

5'-UAAAUAUUGCCAUUAAAUGUAAAUA C^A-3'   (SEQ ID NO: 1760)
                 3'-AUUUAUAACGGUAAUUUACAUUUAU U^G-5'   (SEQ ID NO: 452)

MYC-2181 Target: 5'-TAAATATTGCCATTAAATGTAAATAAC-3'   (SEQ ID NO: 779)
```

TABLE 6-continued

Selected Human Anti-MYC "Blunt/Fray" DsiRNAs

```
              5'-UGCCAUUAAAUGUAAAUAACUUUAA C^C-3'    (SEQ ID NO: 1761)
              3'-ACGGUAAUUUACAUUUAUUGAAAUU A_U-5'   (SEQ ID NO: 453)
```

MYC-2188 Target: 5'-TGCCATTAAATGTAAATAACTTTAATA-3' (SEQ ID NO: 780)

```
              5'-CUUUAAUAAAACGUUUAUAGCAGUU C^A-3'   (SEQ ID NO: 1762)
              3'-GAAAUUAUUUUGCAAAUAUCGUCAA U_G-5'   (SEQ ID NO: 454)
```

MYC-2207 Target: 5'-CTTTAATAAAACGTTTATAGCAGTTAC-3' (SEQ ID NO: 781)

```
              5'-CACAGAAUUUCAAUCCUAGUAUAUA A^C-3'   (SEQ ID NO: 1763)
              3'-GUGUCUUAAAGUUAGGAUCAUAUAU C_A-5'   (SEQ ID NO: 455)
```

MYC-2233 Target: 5'-CACAGAATTTCAATCCTAGTATATAGT-3' (SEQ ID NO: 782)

```
              5'-ACCUAGUAUUAUAGGUACUAUAAAC A^A-3'   (SEQ ID NO: 1764)
              3'-UGGAUCAUAAUAUCCAUGAUAUUUG G_G-5'   (SEQ ID NO: 456)
```

MYC-2260 Target: 5'-ACCTAGTATTATAGGTACTATAAACCC-3' (SEQ ID NO: 783)

```
              5'-AUUAUAGGUACUAUAAACCCUAAUU C^C-3'   (SEQ ID NO: 1765)
              3'-UAAUAUCCAUGAUAUUUGGGAUUAA A_A-5'   (SEQ ID NO: 457)
```

MYC-2267 Target: 5'-ATTATAGGTACTATAAACCCTAATTTT-3' (SEQ ID NO: 784)

```
              5'-GUACUAUAAACCCUAAUUUUUUUUA C^C-3'   (SEQ ID NO: 1766)
              3'-CAUGAUAUUUGGGAUUAAAAAAAAU A_A-5'   (SEQ ID NO: 458)
```

MYC-2274 Target: 5'-GTACTATAAACCCTAATTTTTTTATT-3' (SEQ ID NO: 785)

```
              5'-AACCCUAAUUUUUUUAUUUAAGUA A^C-3'    (SEQ ID NO: 1767)
              3'-UUGGGAUUAAAAAAAUAAAUUCAU G_U-5'   (SEQ ID NO: 459)
```

MYC-2282 Target: 5'-AACCCTAATTTTTTTATTTAAGTACA-3' (SEQ ID NO: 786)

```
              5'-UAAUUUUUUUAUUUAAGUACAUUU C^A-3'    (SEQ ID NO: 1768)
              3'-AUUAAAAAAAUAAAUUCAUGUAAA A_C-5'   (SEQ ID NO: 460)
```

MYC-2287 Target: 5'-TAATTTTTTTATTTAAGTACATTTTG-3' (SEQ ID NO: 787)

```
              5'-UUUAUUUAAGUACAUUUUGCUUUUU C^C-3'   (SEQ ID NO: 1769)
              3'-AAAUAAAUUCAUGUAAAACGAAAAA U_U-5'   (SEQ ID NO: 461)
```

MYC-2295 Target: 5'-TTTATTTAAGTACATTTTGCTTTTTAA-3' (SEQ ID NO: 788)

```
              5'-UUAAGUACAUUUUGCUUUUUAAAGU C^A-3'   (SEQ ID NO: 1770)
              3'-AAUUCAUGUAAAACGAAAAAUUUCA A_C-5'   (SEQ ID NO: 462)
```

MYC-2300 Target: 5'-TTAAGTACATTTTGCTTTTTAAAGTTG-3' (SEQ ID NO: 789)

```
              5'-ACAUUUUGCUUUUUAAAGUUGAUUU C^C-3'   (SEQ ID NO: 1771)
              3'-UGUAAAACGAAAAAUUUCAACUAAA A_A-5'   (SEQ ID NO: 463)
```

MYC-2306 Target: 5'-ACATTTTGCTTTTTAAAGTTGATTTT-3' (SEQ ID NO: 790)

TABLE 6-continued

Selected Human Anti-MYC "Blunt/Fray" DsiRNAs

```
              5'-UGCUUUUUAAAGUUGAUUUUUUCU^CC-3'    (SEQ ID NO: 1772)
              3'-ACGAAAAAUUUCAACUAAAAAAGA_UA-5'   (SEQ ID NO: 464)
```

MYC-2312 Target: 5'-TGCTTTTTAAAGTTGATTTTTTCTAT-3' (SEQ ID NO: 791)

```
              5'-UCUAUUGUUUUUAGAAAAAAUAAAA^CC-3'  (SEQ ID NO: 1773)
              3'-AGAUAACAAAAAUCUUUUUAUUUU_AU-5'   (SEQ ID NO: 465)
```

MYC-2334 Target: 5'-TCTATTGTTTTTAGAAAAAATAAAATA-3' (SEQ ID NO: 792)

```
              5'-UGUUUUUAGAAAAAAUAAAAUAACU^AA-3'  (SEQ ID NO: 1774)
              3'-ACAAAAAUCUUUUUAUUUUAUUGA_CC-5'  (SEQ ID NO: 466)
```

MYC-2339 Target: 5'-TGTTTTTAGAAAAATAAAATAACTGG-3' (SEQ ID NO: 793)

```
              5'-GAAAAAAUAAAAUAACUGGCAAAUA^CC-3'  (SEQ ID NO: 1775)
              3'-CUUUUUUAUUUUAUUGACCGUUUAU_AU-5'  (SEQ ID NO: 467)
```

MYC-2347 Target: 5'-GAAAAAATAAAATAACTGGCAAATATA-3' (SEQ ID NO: 794)

```
              5'-AAAAUAACUGGCAAAUAUAUCAUUG^CA-3'  (SEQ ID NO: 1776)
              3'-UUUUAUUGACCGUUUAUAUAGUAAC_UC-5'  (SEQ ID NO: 468)
```

MYC-2355 Target: 5'-AAAATAACTGGCAAATATATCATTGAG-3' (SEQ ID NO: 795)

```
              5'-GGCAAAUAUAUCAUUGAGCCAAAUC^CC-3'  (SEQ ID NO: 1777)
              3'-CCGUUUAUAUAGUAACUCGGUUUAG_AA-5'  (SEQ ID NO: 469)
```

MYC-2364 Target: 5'-GGCAAATATATCATTGAGCCAAATCTT-3' (SEQ ID NO: 796)

```
              5'-AUAUCAUUGAGCCAAAUCUUAAAAA^CC-3'  (SEQ ID NO: 1778)
              3'-UAUAGUAACUCGGUUUAGAAUUUUU_UU-5'  (SEQ ID NO: 470)
```

MYC-2371 Target: 5'-ATATCATTGAGCCAAATCTTAAAAAAA-3' (SEQ ID NO: 797)

```
              5'-UUGAGCCAAAUCUUAAAAAAAAAAA^CC-3'  (SEQ ID NO: 1779)
              3'-AACUCGGUUUAGAAUUUUUUUUUUU_UU-5'  (SEQ ID NO: 471)
```

MYC-2377 Target: 5'-TTGAGCCAAATCTTAAAAAAAAAAAA-3' (SEQ ID NO: 798)

```
              5'-UAACUCGCUGUAGUAAUUCCAGCGA^AC-3'  (SEQ ID NO: 1780)
              3'-AUUGAGCGACAUCAUUAAGGUCGCU_CU-5'  (SEQ ID NO: 472)
```

MYC-188 Target: 5'-TAACTCGCTGTAGTAATTCCAGCGAGA-3' (SEQ ID NO: 799)

```
              5'-AACUCGCUGUAGUAAUUCCAGCGAG^CA-3'  (SEQ ID NO: 1781)
              3'-UUGAGCGACAUCAUUAAGGUCGCUC_UC-5'  (SEQ ID NO: 473)
```

MYC-189 Target: 5'-AACTCGCTGTAGTAATTCCAGCGAGAG-3' (SEQ ID NO: 800)

```
              5'-ACUCGCUGUAGUAAUUCCAGCGAGA^AA-3'  (SEQ ID NO: 1782)
              3'-UGAGCGACAUCAUUAAGGUCGCUCU_CC-5'  (SEQ ID NO: 474)
```

MYC-190 Target: 5'-ACTCGCTGTAGTAATTCCAGCGAGAGG-3' (SEQ ID NO: 801)

TABLE 6-continued

Selected Human Anti-MYC "Blunt/Fray" DsiRNAs

```
              5'-CUCGCUGUAGUAAUUCCAGCGAGAG^AA-3'    (SEQ ID NO: 1783)
              3'-GAGCGACAUCAUUAAGGUCGCUCUC_CG-5'   (SEQ ID NO: 475)

MYC-191 Target: 5'-CTCGCTGTAGTAATTCCAGCGAGAGGC-3'  (SEQ ID NO: 802)

5'-UCGCUGUAGUAAUUCCAGCGAGAGG^AC-3'   (SEQ ID NO: 1784)
              3'-AGCGACAUCAUUAAGGUCGCUCUCC_GU-5'   (SEQ ID NO: 476)

MYC-192 Target: 5'-TCGCTGTAGTAATTCCAGCGAGAGGCA-3' (SEQ ID NO: 803)

5'-CGCUGUAGUAAUUCCAGCGAGAGGC^CA-3'   (SEQ ID NO: 1785)
              3'-GCGACAUCAUUAAGGUCGCUCUCCG_UC-5'   (SEQ ID NO: 477)

MYC-193 Target: 5'-CGCTGTAGTAATTCCAGCGAGAGGCAG-3' (SEQ ID NO: 804)

5'-GCUGUAGUAAUUCCAGCGAGAGGCA^AC-3'   (SEQ ID NO: 1786)
              3'-CGACAUCAUUAAGGUCGCUCUCCGU_CU-5'   (SEQ ID NO: 478)

MYC-194 Target: 5'-GCTGTAGTAATTCCAGCGAGAGGCAGA-3' (SEQ ID NO: 805)

5'-CUGUAGUAAUUCCAGCGAGAGGCAG^CA-3'   (SEQ ID NO: 1787)
              3'-GACAUCAUUAAGGUCGCUCUCCGUC_UC-5'   (SEQ ID NO: 479)

MYC-195 Target: 5'-CTGTAGTAATTCCAGCGAGAGGCAGAG-3' (SEQ ID NO: 806)

5'-AGCUUCACCAACAGGAACUAUGACC^CA-3'   (SEQ ID NO: 1788)
              3'-UCGAAGUGGUUGUCCUUGAUACUGG_AG-5'   (SEQ ID NO: 480)

MYC-612 Target: 5'-AGCTTCACCAACAGGAACTATGACCTC-3' (SEQ ID NO: 807)

5'-GCUUCACCAACAGGAACUAUGACCU^AA-3'   (SEQ ID NO: 1789)
              3'-CGAAGUGGUUGUCCUUGAUACUGGA_GC-5'   (SEQ ID NO: 481)

MYC-613 Target: 5'-GCTTCACCAACAGGAACTATGACCTCG-3' (SEQ ID NO: 808)

5'-CUUCACCAACAGGAACUAUGACCUC^AC-3'   (SEQ ID NO: 1790)
              3'-GAAGUGGUUGUCCUUGAUACUGGAG_CU-5'   (SEQ ID NO: 482)

MYC-614 Target: 5'-CTTCACCAACAGGAACTATGACCTCGA-3' (SEQ ID NO: 809)

5'-UUCACCAACAGGAACUAUGACCUCG^CA-3'   (SEQ ID NO: 1791)
              3'-AAGUGGUUGUCCUUGAUACUGGAGC_UG-5'   (SEQ ID NO: 483)

MYC-615 Target: 5'-TTCACCAACAGGAACTATGACCTCGAC-3' (SEQ ID NO: 810)

5'-UCACCAACAGGAACUAUGACCUCGA^AC-3'   (SEQ ID NO: 1792)
              3'-AGUGGUUGUCCUUGAUACUGGAGCU_GA-5'   (SEQ ID NO: 484)

MYC-616 Target: 5'-TCACCAACAGGAACTATGACCTCGACT-3' (SEQ ID NO: 811)

5'-CACCAACAGGAACUAUGACCUCGAC^CC-3'   (SEQ ID NO: 1793)
              3'-GUGGUUGUCCUUGAUACUGGAGCUG_AU-5'   (SEQ ID NO: 485)

MYC-617 Target: 5'-CACCAACAGGAACTATGACCTCGACTA-3' (SEQ ID NO: 812)
```

TABLE 6-continued

Selected Human Anti-MYC "Blunt/Fray" DsiRNAs

```
              5'-ACCAACAGGAACUAUGACCUCGACUC^A-3'    (SEQ ID NO: 1794)
              3'-UGGUUGUCCUUGAUACUGGAGCUGA_UG-5'   (SEQ ID NO: 486)
```

MYC-618 Target: 5'-ACCAACAGGAACTATGACCTCGACTAC-3' (SEQ ID NO: 813)

```
              5'-CCAACAGGAACUAUGACCUCGACUA^AA-3'   (SEQ ID NO: 1795)
              3'-GGUUGUCCUUGAUACUGGAGCUGAU_GC-5'   (SEQ ID NO: 487)
```

MYC-619 Target: 5'-CCAACAGGAACTATGACCTCGACTACG-3' (SEQ ID NO: 814)

```
              5'-CAACAGGAACUAUGACCUCGACUAC^AC-3'   (SEQ ID NO: 1796)
              3'-GUUGUCCUUGAUACUGGAGCUGAUG_CU-5'   (SEQ ID NO: 488)
```

MYC-620 Target: 5'-CAACAGGAACTATGACCTCGACTACGA-3' (SEQ ID NO: 815)

```
              5'-AACAGGAACUAUGACCUCGACUACG^CA-3'   (SEQ ID NO: 1797)
              3'-UUGUCCUUGAUACUGGAGCUGAUGC_UG-5'   (SEQ ID NO: 489)
```

MYC-621 Target: 5'-AACAGGAACTATGACCTCGACTACGAC-3' (SEQ ID NO: 816)

```
              5'-ACAGGAACUAUGACCUCGACUACGA^AC-3'   (SEQ ID NO: 1798)
              3'-UGUCCUUGAUACUGGAGCUGAUGCU_GA-5'   (SEQ ID NO: 490)
```

MYC-622 Target: 5'-ACAGGAACTATGACCTCGACTACGACT-3' (SEQ ID NO: 817)

```
              5'-CAGGAACUAUGACCUCGACUACGAC^CA-3'   (SEQ ID NO: 1799)
              3'-GUCCUUGAUACUGGAGCUGAUGCUG_AG-5'   (SEQ ID NO: 491)
```

MYC-623 Target: 5'-CAGGAACTATGACCTCGACTACGACTC-3' (SEQ ID NO: 818)

```
              5'-AGGAACUAUGACCUCGACUACGACU^AA-3'   (SEQ ID NO: 1800)
              3'-UCCUUGAUACUGGAGCUGAUGCUGA_GC-5'   (SEQ ID NO: 492)
```

MYC-624 Target: 5'-AGGAACTATGACCTCGACTACGACTCG-3' (SEQ ID NO: 819)

```
              5'-GGAACUAUGACCUCGACUACGACUC^AA-3'   (SEQ ID NO: 1801)
              3'-CCUUGAUACUGGAGCUGAUGCUGAG_CC-5'   (SEQ ID NO: 493)
```

MYC-625 Target: 5'-GGAACTATGACCTCGACTACGACTCGG-3' (SEQ ID NO: 820)

```
              5'-GAACUAUGACCUCGACUACGACUCG^AC-3'   (SEQ ID NO: 1802)
              3'-CUUGAUACUGGAGCUGAUGCUGAGC_CA-5'   (SEQ ID NO: 494)
```

MYC-626 Target: 5'-GAACTATGACCTCGACTACGACTCGGT-3' (SEQ ID NO: 821)

```
              5'-AACUAUGACCUCGACUACGACUCGG^CA-3'   (SEQ ID NO: 1803)
              3'-UUGAUACUGGAGCUGAUGCUGAGCC_AC-5'   (SEQ ID NO: 495)
```

MYC-627 Target: 5'-AACTATGACCTCGACTACGACTCGGTG-3' (SEQ ID NO: 822)

```
              5'-ACUAUGACCUCGACUACGACUCGGU^AA-3'   (SEQ ID NO: 1804)
              3'-UGAUACUGGAGCUGAUGCUGAGCCA_CG-5'   (SEQ ID NO: 496)
```

MYC-628 Target: 5'-ACTATGACCTCGACTACGACTCGGTGC-3' (SEQ ID NO: 823)

TABLE 6-continued

Selected Human Anti-MYC "Blunt/Fray" DsiRNAs

```
           5'-CUAUGACCUCGACUACGACUCGGUG A C-3'   (SEQ ID NO: 1805)
           3'-GAUACUGGAGCUGAUGCUGAGCCAC G U-5'   (SEQ ID NO: 497)

MYC-629 Target: 5'-CTATGACCTCGACTACGACTCGGTGCA-3'  (SEQ ID NO: 824)

5'-GCGAGGAUAUCUGGAAGAAAUUCGA A A-3'   (SEQ ID NO: 1806)
           3'-CGCUCCUAUAGACCUUCUUUAAGCU C G-5'   (SEQ ID NO: 498)

MYC-733 Target: 5'-GCGAGGATATCTGGAAGAAATTCGAGC-3'  (SEQ ID NO: 825)

5'-CGAGGAUAUCUGGAAGAAAUUCGAG A C-3'   (SEQ ID NO: 1807)
           3'-GCUCCUAUAGACCUUCUUUAAGCUC G A-5'   (SEQ ID NO: 499)

MYC-734 Target: 5'-CGAGGATATCTGGAAGAAATTCGAGCT-3'  (SEQ ID NO: 826)

5'-GAGGAUAUCUGGAAGAAAUUCGAGC C A-3'   (SEQ ID NO: 1808)
           3'-CUCCUAUAGACCUUCUUUAAGCUCG A C-5'   (SEQ ID NO: 500)

MYC-735 Target: 5'-GAGGATATCTGGAAGAAATTCGAGCTG-3'  (SEQ ID NO: 827)

5'-AGGAUAUCUGGAAGAAAUUCGAGCU A A-3'   (SEQ ID NO: 1809)
           3'-UCCUAUAGACCUUCUUUAAGCUCGA C G-5'   (SEQ ID NO: 501)

MYC-736 Target: 5'-AGGATATCTGGAAGAAATTCGAGCTGC-3'  (SEQ ID NO: 828)

5'-GGAUAUCUGGAAGAAAUUCGAGCUG A C-3'   (SEQ ID NO: 1810)
           3'-CCUAUAGACCUUCUUUAAGCUCGAC G A-5'   (SEQ ID NO: 502)

MYC-737 Target: 5'-GGATATCTGGAAGAAATTCGAGCTGCT-3'  (SEQ ID NO: 829)

5'-GAUAUCUGGAAGAAAUUCGAGCUGC A A-3'   (SEQ ID NO: 1811)
           3'-CUAUAGACCUUCUUUAAGCUCGACG A C-5'   (SEQ ID NO: 503)

MYC-738 Target: 5'-GATATCTGGAAGAAATTCGAGCTGCTG-3'  (SEQ ID NO: 830)

5'-AUAUCUGGAAGAAAUUCGAGCUGCU A A-3'   (SEQ ID NO: 1812)
           3'-UAUAGACCUUCUUUAAGCUCGACGA C G-5'   (SEQ ID NO: 504)

MYC-739 Target: 5'-ATATCTGGAAGAAATTCGAGCTGCTGC-3'  (SEQ ID NO: 831)

5'-UAUCUGGAAGAAAUUCGAGCUGCUG A A-3'   (SEQ ID NO: 1813)
           3'-AUAGACCUUCUUUAAGCUCGACGAC G G-5'   (SEQ ID NO: 505)

MYC-740 Target: 5'-TATCTGGAAGAAATTCGAGCTGCTGCC-3'  (SEQ ID NO: 832)

5'-AUCUGGAAGAAAUUCGAGCUGCUGC A A-3'   (SEQ ID NO: 1814)
           3'-UAGACCUUCUUUAAGCUCGACGACG G G-5'   (SEQ ID NO: 506)

MYC-741 Target: 5'-ATCTGGAAGAAATTCGAGCTGCTGCCC-3'  (SEQ ID NO: 833)

5'-UCUGGAAGAAAUUCGAGCUGCUGCC A C-3'   (SEQ ID NO: 1815)
           3'-AGACCUUCUUUAAGCUCGACGACGG G U-5'   (SEQ ID NO: 507)

MYC-742 Target: 5'-TCTGGAAGAAATTCGAGCTGCTGCCCA-3'  (SEQ ID NO: 834)
```

TABLE 6-continued

Selected Human Anti-MYC "Blunt/Fray" DsiRNAs

```
            5'-CUGGAAGAAAUUCGAGCUGCUGCCC^CA-3'    (SEQ ID NO: 1816)
            3'-GACCUUCUUUAAGCUCGACGACGGG_UG-5'   (SEQ ID NO: 508)
```

MYC-743 Target: 5'-CTGGAAGAAATTCGAGCTGCTGCCCAC-3' (SEQ ID NO: 835)

```
            5'-CUAGCCGCCGCUCCGGGCUCUGCUC^AA-3'   (SEQ ID NO: 1817)
            3'-GAUCGGCGGCGAGGCCCGAGACGAG_CG-5'   (SEQ ID NO: 509)
```

MYC-784 Target: 5'-CTAGCCGCCGCTCCGGGCTCTGCTCGC-3' (SEQ ID NO: 836)

```
            5'-UAGCCGCCGCUCCGGGCUCUGCUCG^AA-3'   (SEQ ID NO: 1818)
            3'-AUCGGCGGCGAGGCCCGAGACGAGC_GG-5'   (SEQ ID NO: 510)
```

MYC-785 Target: 5'-TAGCCGCCGCTCCGGGCTCTGCTCGCC-3' (SEQ ID NO: 837)

```
            5'-AGCCGCCGCUCCGGGCUCUGCUCGC^AA-3'   (SEQ ID NO: 1819)
            3'-UCGGCGGCGAGGCCCGAGACGAGCG_GG-5'   (SEQ ID NO: 511)
```

MYC-786 Target: 5'-AGCCGCCGCTCCGGGCTCTGCTCGCCC-3' (SEQ ID NO: 838)

```
            5'-GCCGCCGCUCCGGGCUCUGCUCGCC^AC-3'   (SEQ ID NO: 1820)
            3'-CGGCGGCGAGGCCCGAGACGAGCGG_GA-5'   (SEQ ID NO: 512)
```

MYC-787 Target: 5'-GCCGCCGCTCCGGGCTCTGCTCGCCCT-3' (SEQ ID NO: 839)

```
            5'-CCGCCGCUCCGGGCUCUGCUCGCCC^CA-3'   (SEQ ID NO: 1821)
            3'-GGCGGCGAGGCCCGAGACGAGCGGG_AG-5'   (SEQ ID NO: 513)
```

MYC-788 Target: 5'-CCGCCGCTCCGGGCTCTGCTCGCCCTC-3' (SEQ ID NO: 840)

```
            5'-UGGGAGGAGACAUGGUGAACCAGAG^CC-3'   (SEQ ID NO: 1822)
            3'-ACCCUCCUCUGUACCACUUGGUCUC_AA-5'   (SEQ ID NO: 514)
```

MYC-913 Target: 5'-TGGGAGGAGACATGGTGAACCAGAGTT-3' (SEQ ID NO: 841)

```
            5'-GGGAGGAGACAUGGUGAACCAGAGU^CC-3'   (SEQ ID NO: 1823)
            3'-CCCUCCUCUGUACCACUUGGUCUCA_AA-5'   (SEQ ID NO: 515)
```

MYC-914 Target: 5'-GGGAGGAGACATGGTGAACCAGAGTTT-3' (SEQ ID NO: 842)

```
            5'-GGAGGAGACAUGGUGAACCAGAGUU^CA-3'   (SEQ ID NO: 1824)
            3'-CCUCCUCUGUACCACUUGGUCUCAA_AG-5'   (SEQ ID NO: 516)
```

MYC-915 Target: 5'-GGAGGAGACATGGTGAACCAGAGTTTC-3' (SEQ ID NO: 843)

```
            5'-GAGGAGACAUGGUGAACCAGAGUUU^AC-3'   (SEQ ID NO: 1825)
            3'-CUCCUCUGUACCACUUGGUCUCAAA_GU-5'   (SEQ ID NO: 517)
```

MYC-916 Target: 5'-GAGGAGACATGGTGAACCAGAGTTTCA-3' (SEQ ID NO: 844)

```
            5'-AGGAGACAUGGUGAACCAGAGUUUC^CC-3'   (SEQ ID NO: 1826)
            3'-UCCUCUGUACCACUUGGUCUCAAAG_UA-5'   (SEQ ID NO: 518)
```

MYC-917 Target: 5'-AGGAGACATGGTGAACCAGAGTTTCAT-3' (SEQ ID NO: 845)

TABLE 6-continued

Selected Human Anti-MYC "Blunt/Fray" DsiRNAs

```
            5'-CGGACGACGAGACCUUCAUCAAAAA A C-3'    (SEQ ID NO: 1827)
            3'-GCCUGCUGCUCUGGAAGUAGUUUUU G U-5'    (SEQ ID NO: 519)
```

MYC-952 Target: 5'-CGGACGACGAGACCTTCATCAAAAACA-3'  (SEQ ID NO: 846)

```
            5'-GGACGACGAGACCUUCAUCAAAAAC C C-3'    (SEQ ID NO: 1828)
            3'-CCUGCUGCUCUGGAAGUAGUUUUUG U A-5'    (SEQ ID NO: 520)
```

MYC-953 Target: 5'-GGACGACGAGACCTTCATCAAAAACAT-3'  (SEQ ID NO: 847)

```
            5'-AAAACAUCAUCAUCCAGGACUGUAU A C-3'    (SEQ ID NO: 1829)
            3'-UUUUGUAGUAGUAGGUCCUGACAUA C A-5'    (SEQ ID NO: 521)
```

MYC-973 Target: 5'-AAAACATCATCATCCAGGACTGTATGT-3'  (SEQ ID NO: 848)

```
            5'-AAACAUCAUCAUCCAGGACUGUAUG C A-3'    (SEQ ID NO: 1830)
            3'-UUUGUAGUAGUAGGUCCUGACAUAC A C-5'    (SEQ ID NO: 522)
```

MYC-974 Target: 5'-AAACATCATCATCCAGGACTGTATGTG-3'  (SEQ ID NO: 849)

```
            5'-AACAUCAUCAUCCAGGACUGUAUGU A A-3'    (SEQ ID NO: 1831)
            3'-UUGUAGUAGUAGGUCCUGACAUACA C C-5'    (SEQ ID NO: 523)
```

MYC-975 Target: 5'-AACATCATCATCCAGGACTGTATGTGG-3'  (SEQ ID NO: 850)

```
            5'-ACAUCAUCAUCCAGGACUGUAUGUG A C-3'    (SEQ ID NO: 1832)
            3'-UGUAGUAGUAGGUCCUGACAUACAC C U-5'    (SEQ ID NO: 524)
```

MYC-976 Target: 5'-ACATCATCATCCAGGACTGTATGTGGA-3'  (SEQ ID NO: 851)

```
            5'-CAUCAUCAUCCAGGACUGUAUGUGG C A-3'    (SEQ ID NO: 1833)
            3'-GUAGUAGUAGGUCCUGACAUACACC U C-5'    (SEQ ID NO: 525)
```

MYC-977 Target: 5'-CATCATCATCCAGGACTGTATGTGGAG-3'  (SEQ ID NO: 852)

```
            5'-AUCAUCAUCCAGGACUGUAUGUGGA A A-3'    (SEQ ID NO: 1834)
            3'-UAGUAGUAGGUCCUGACAUACACCU C G-5'    (SEQ ID NO: 526)
```

MYC-978 Target: 5'-ATCATCATCCAGGACTGTATGTGGAGC-3'  (SEQ ID NO: 853)

```
            5'-UCAUCAUCCAGGACUGUAUGUGGAG A A-3'    (SEQ ID NO: 1835)
            3'-AGUAGUAGGUCCUGACAUACACCUC G C-5'    (SEQ ID NO: 527)
```

MYC-979 Target: 5'-TCATCATCCAGGACTGTATGTGGAGCG-3'  (SEQ ID NO: 854)

```
            5'-CAUCAUCCAGGACUGUAUGUGGAGC A A-3'    (SEQ ID NO: 1836)
            3'-GUAGUAGGUCCUGACAUACACCUCG C C-5'    (SEQ ID NO: 528)
```

MYC-980 Target: 5'-CATCATCCAGGACTGTATGTGGAGCGG-3'  (SEQ ID NO: 855)

```
            5'-AUCAUCCAGGACUGUAUGUGGAGCG A A-3'    (SEQ ID NO: 1837)
            3'-UAGUAGGUCCUGACAUACACCUCGC C G-5'    (SEQ ID NO: 529)
```

MYC-981 Target: 5'-ATCATCCAGGACTGTATGTGGAGCGGC-3'  (SEQ ID NO: 856)

TABLE 6-continued

Selected Human Anti-MYC "Blunt/Fray" DsiRNAs

```
               5'-UCAUCCAGGACUGUAUGUGGAGCGG AC-3'    (SEQ ID NO: 1838)
               3'-AGUAGGUCCUGACAUACACCUCGCC GA-5'    (SEQ ID NO: 530)

MYC-982 Target: 5'-TCATCCAGGACTGTATGTGGAGCGGCT-3'    (SEQ ID NO: 857)

5'-CAUCCAGGACUGUAUGUGGAGCGGC CC-3'    (SEQ ID NO: 1839)
               3'-GUAGGUCCUGACAUACACCUCGCCG AA-5'    (SEQ ID NO: 531)

MYC-983 Target: 5'-CATCCAGGACTGTATGTGGAGCGGCTT-3'   (SEQ ID NO: 858)

5'-AUCCAGGACUGUAUGUGGAGCGGCU CA-3'    (SEQ ID NO: 1840)
               3'-UAGGUCCUGACAUACACCUCGCCGA AG-5'    (SEQ ID NO: 532)

MYC-984 Target: 5'-ATCCAGGACTGTATGTGGAGCGGCTTC-3'   (SEQ ID NO: 859)

5'-UCCAGGACUGUAUGUGGAGCGGCUU AC-3'    (SEQ ID NO: 1841)
               3'-AGGUCCUGACAUACACCUCGCCGAA GA-5'    (SEQ ID NO: 533)

MYC-985 Target: 5'-TCCAGGACTGTATGTGGAGCGGCTTCT-3'   (SEQ ID NO: 860)

5'-CCAGGACUGUAUGUGGAGCGGCUUC CA-3'    (SEQ ID NO: 1842)
               3'-GGUCCUGACAUACACCUCGCCGAAG AG-5'    (SEQ ID NO: 534)

MYC-986 Target: 5'-CCAGGACTGTATGTGGAGCGGCTTCTC-3'   (SEQ ID NO: 861)

5'-CAGAGAAGCUGGCCUCCUACCAGGC CA-3'    (SEQ ID NO: 1843)
               3'-GUCUCUUCGACCGGAGGAUGGUCCG AC-5'    (SEQ ID NO: 535)

MYC-1033 Target: 5'-CAGAGAAGCTGGCCTCCTACCAGGCTG-3'  (SEQ ID NO: 862)

5'-AGAGAAGCUGGCCUCCUACCAGGCU AA-3'    (SEQ ID NO: 1844)
               3'-UCUCUUCGACCGGAGGAUGGUCCGA CG-5'    (SEQ ID NO: 536)

MYC-1034 Target: 5'-AGAGAAGCTGGCCTCCTACCAGGCTGC-3'  (SEQ ID NO: 863)

5'-GAGAAGCUGGCCUCCUACCAGGCUG AA-3'    (SEQ ID NO: 1845)
               3'-CUCUUCGACCGGAGGAUGGUCCGAC GC-5'    (SEQ ID NO: 537)

MYC-1035 Target: 5'-GAGAAGCTGGCCTCCTACCAGGCTGCG-3'  (SEQ ID NO: 864)

5'-AGAAGCUGGCCUCCUACCAGGCUGC AA-3'    (SEQ ID NO: 1846)
               3'-UCUUCGACCGGAGGAUGGUCCGACG CG-5'    (SEQ ID NO: 538)

MYC-1036 Target: 5'-AGAAGCTGGCCTCCTACCAGGCTGCGC-3'  (SEQ ID NO: 865)

5'-GAAGCUGGCCUCCUACCAGGCUGCG AA-3'    (SEQ ID NO: 1847)
               3'-CUUCGACCGGAGGAUGGUCCGACGC GC-5'    (SEQ ID NO: 539)

MYC-1037 Target: 5'-GAAGCTGGCCTCCTACCAGGCTGCGCG-3'  (SEQ ID NO: 866)

5'-AAGCUGGCCUCCUACCAGGCUGCGC AA-3'    (SEQ ID NO: 1848)
               3'-UUCGACCGGAGGAUGGUCCGACGCG CG-5'    (SEQ ID NO: 540)

MYC-1038 Target: 5'-AAGCTGGCCTCCTACCAGGCTGCGCGC-3'  (SEQ ID NO: 867)
```

TABLE 6-continued

Selected Human Anti-MYC "Blunt/Fray" DsiRNAs

```
                5'-AGCUGGCCUCCUACCAGGCUGCGCG A C-3'    (SEQ ID NO: 1849)
                3'-UCGACCGGAGGAUGGUCCGACGCGC G U-5'    (SEQ ID NO: 541)
```

MYC-1039 Target: 5'-AGCTGGCCTCCTACCAGGCTGCGCGCA-3' (SEQ ID NO: 868)

```
                5'-GCUGGCCUCCUACCAGGCUGCGCGC C C-3'    (SEQ ID NO: 1850)
                3'-CGACCGGAGGAUGGUCCGACGCGCC U U-5'    (SEQ ID NO: 542)
```

MYC-1040 Target: 5'-GCTGGCCTCCTACCAGGCTGCGCGCAA-3' (SEQ ID NO: 869)

```
                5'-CUGGCCUCCUACCAGGCUGCGCGCA C C-3'    (SEQ ID NO: 1851)
                3'-GACCGGAGGAUGGUCCGACGCGCGU U U-5'    (SEQ ID NO: 543)
```

MYC-1041 Target: 5'-CTGGCCTCCTACCAGGCTGCGCGCAAA-3' (SEQ ID NO: 870)

```
                5'-UGGCCUCCUACCAGGCUGCGCGCAA C A-3'    (SEQ ID NO: 1852)
                3'-ACCGGAGGAUGGUCCGACGCGCGUU U C-5'    (SEQ ID NO: 544)
```

MYC-1042 Target: 5'-TGGCCTCCTACCAGGCTGCGCGCAAAG-3' (SEQ ID NO: 871)

```
                5'-GGCCUCCUACCAGGCUGCGCGCAAA A C-3'    (SEQ ID NO: 1853)
                3'-CCGGAGGAUGGUCCGACGCGCGUUU C U-5'    (SEQ ID NO: 545)
```

MYC-1043 Target: 5'-GGCCTCCTACCAGGCTGCGCGCAAAGA-3' (SEQ ID NO: 872)

```
                5'-GCCUCCUACCAGGCUGCGCGCAAAG C A-3'    (SEQ ID NO: 1854)
                3'-CGGAGGAUGGUCCGACGCGCGUUUC U G-5'    (SEQ ID NO: 546)
```

MYC-1044 Target: 5'-GCCTCCTACCAGGCTGCGCGCAAAGAC-3' (SEQ ID NO: 873)

```
                5'-CCUCCUACCAGGCUGCGCGCAAAGA A C-3'    (SEQ ID NO: 1855)
                3'-GGAGGAUGGUCCGACGCGCGUUUCU G U-5'    (SEQ ID NO: 547)
```

MYC-1045 Target: 5'-CCTCCTACCAGGCTGCGCGCAAAGACA-3' (SEQ ID NO: 874)

```
                5'-CUCCUACCAGGCUGCGCGCAAAGAC C A-3'    (SEQ ID NO: 1856)
                3'-GAGGAUGGUCCGACGCGCGUUUCUG U C-5'    (SEQ ID NO: 548)
```

MYC-1046 Target: 5'-CTCCTACCAGGCTGCGCGCAAAGACAG-3' (SEQ ID NO: 875)

```
                5'-UCCUACCAGGCUGCGCGCAAAGACA A A-3'    (SEQ ID NO: 1857)
                3'-AGGAUGGUCCGACGCGCGUUUCUGU C G-5'    (SEQ ID NO: 549)
```

MYC-1047 Target: 5'-TCCTACCAGGCTGCGCGCAAAGACAGC-3' (SEQ ID NO: 876)

```
                5'-CCUACCAGGCUGCGCGCAAAGACAG A A-3'    (SEQ ID NO: 1858)
                3'-GGAUGGUCCGACGCGCGUUUCUGUC G C-5'    (SEQ ID NO: 550)
```

MYC-1048 Target: 5'-CCTACCAGGCTGCGCGCAAAGACAGCG-3' (SEQ ID NO: 877)

```
                5'-CUACCAGGCUGCGCGCAAAGACAGC A A-3'    (SEQ ID NO: 1859)
                3'-GAUGGUCCGACGCGCGUUUCUGUCG C C-5'    (SEQ ID NO: 551)
```

MYC-1049 Target: 5'-CTACCAGGCTGCGCGCAAAGACAGCGG-3' (SEQ ID NO: 878)

TABLE 6-continued

Selected Human Anti-MYC "Blunt/Fray" DsiRNAs

```
              5'-UACCAGGCUGCGCGCAAAGACAGCG^A A-3'    (SEQ ID NO: 1860)
              3'-AUGGUCCGACGCGCGUUUCUGUCGC_C G-5'   (SEQ ID NO: 552)

MYC-1050 Target: 5'-TACCAGGCTGCGCGCAAAGACAGCGGC-3'  (SEQ ID NO: 879)

5'-ACCAGGCUGCGCGCAAAGACAGCGG^A C-3'   (SEQ ID NO: 1861)
              3'-UGGUCCGACGCGCGUUUCUGUCGCC_G U-5'   (SEQ ID NO: 553)

MYC-1051 Target: 5'-ACCAGGCTGCGCGCAAAGACAGCGGCA-3'  (SEQ ID NO: 880)

5'-CCAGGCUGCGCGCAAAGACAGCGGC^C A-3'   (SEQ ID NO: 1862)
              3'-GGUCCGACGCGCGUUUCUGUCGCCG_U C-5'   (SEQ ID NO: 554)

MYC-1052 Target: 5'-CCAGGCTGCGCGCAAAGACAGCGGCAG-3'  (SEQ ID NO: 881)

5'-CAGGCUGCGCGCAAAGACAGCGGCA^A A-3'   (SEQ ID NO: 1863)
              3'-GUCCGACGCGCGUUUCUGUCGCCGU_C G-5'   (SEQ ID NO: 555)

MYC-1053 Target: 5'-CAGGCTGCGCGCAAAGACAGCGGCAGC-3'  (SEQ ID NO: 882)

5'-GCCACAGCGUCUGCUCCACCUCCAG^A C-3'   (SEQ ID NO: 1864)
              3'-CGGUGUCGCAGACGAGGUGGAGGUC_G A-5'   (SEQ ID NO: 556)

MYC-1096 Target: 5'-GCCACAGCGTCTGCTCCACCTCCAGCT-3'  (SEQ ID NO: 883)

5'-CCACAGCGUCUGCUCCACCUCCAGC^C C-3'   (SEQ ID NO: 1865)
              3'-GGUGUCGCAGACGAGGUGGAGGUCG_A A-5'   (SEQ ID NO: 557)

MYC-1097 Target: 5'-CCACAGCGTCTGCTCCACCTCCAGCTT-3' (SEQ ID NO: 884)

5'-CACAGCGUCUGCUCCACCUCCAGCU^C A-3'   (SEQ ID NO: 1866)
              3'-GUGUCGCAGACGAGGUGGAGGUCGA_A C-5'   (SEQ ID NO: 558)

MYC-1098 Target: 5'-CACAGCGTCTGCTCCACCTCCAGCTTG-3' (SEQ ID NO: 885)

5'-ACAGCGUCUGCUCCACCUCCAGCUU^A C-3'   (SEQ ID NO: 1867)
              3'-UGUCGCAGACGAGGUGGAGGUCGAA_C A-5'   (SEQ ID NO: 559)

MYC-1099 Target: 5'-ACAGCGTCTGCTCCACCTCCAGCTTGT-3' (SEQ ID NO: 886)

5'-CAGCGUCUGCUCCACCUCCAGCUUG^C C-3'   (SEQ ID NO: 1868)
              3'-GUCGCAGACGAGGUGGAGGUCGAAC_A U-5'   (SEQ ID NO: 560)

MYC-1100 Target: 5'-CAGCGTCTGCTCCACCTCCAGCTTGTA-3' (SEQ ID NO: 887)

5'-AGCGUCUGCUCCACCUCCAGCUUGU^C A-3'   (SEQ ID NO: 1869)
              3'-UCGCAGACGAGGUGGAGGUCGAACA_U G-5'   (SEQ ID NO: 561)

MYC-1101 Target: 5'-AGCGTCTGCTCCACCTCCAGCTTGTAC-3' (SEQ ID NO: 888)

5'-CUCUCAACGACAGCAGCUCGCCCAA^A C-3'   (SEQ ID NO: 1870)
              3'-GAGAGUUGCUGUCGUCGAGCGGGUU_C A-5'   (SEQ ID NO: 562)

MYC-1189 Target: 5'-CTCTCAACGACAGCAGCTCGCCCAAGT-3' (SEQ ID NO: 889)
```

TABLE 6-continued

Selected Human Anti-MYC "Blunt/Fray" DsiRNAs

```
          5'-UCUCAACGACAGCAGCUCGCCCAAG C^A-3'   (SEQ ID NO: 1871)
          3'-AGAGUUGCUGUCGUCGAGCGGGUUC A G-5'   (SEQ ID NO: 563)
```

MYC-1190 Target: 5'-TCTCAACGACAGCAGCTCGCCCAAGTC-3' (SEQ ID NO: 890)

```
          5'-CUCAACGACAGCAGCUCGCCCAAGU A^A-3'   (SEQ ID NO: 1872)
          3'-GAGUUGCUGUCGUCGAGCGGGUUCA G-5'    (SEQ ID NO: 564)
```

MYC-1191 Target: 5'-CTCAACGACAGCAGCTCGCCCAAGTCC-3' (SEQ ID NO: 891)

```
          5'-UCAACGACAGCAGCUCGCCCAAGUC^A C-3'  (SEQ ID NO: 1873)
          3'-AGUUGCUGUCGUCGAGCGGGUUCAG A-5'    (SEQ ID NO: 565)
```

MYC-1192 Target: 5'-TCAACGACAGCAGCTCGCCCAAGTCCT-3' (SEQ ID NO: 892)

```
          5'-CAACGACAGCAGCUCGCCCAAGUCC C^A-3'  (SEQ ID NO: 1874)
          3'-GUUGCUGUCGUCGAGCGGGUUCAGG A C-5'  (SEQ ID NO: 566)
```

MYC-1193 Target: 5'-CAACGACAGCAGCTCGCCCAAGTCCTG-3' (SEQ ID NO: 893)

```
          5'-UCCAUGAGGAGACACCGCCCACCAC A^C-3'  (SEQ ID NO: 1875)
          3'-AGGUACUCCUCUGUGGCGGGUGGUG U-5'    (SEQ ID NO: 567)
```

MYC-1315 Target: 5'-TCCATGAGGAGACACCGCCCACCACCA-3' (SEQ ID NO: 894)

```
          5'-CCAUGAGGAGACACCGCCCACCACC C^A-3'  (SEQ ID NO: 1876)
          3'-GGUACUCCUCUGUGGCGGGUGGUGG U C-5'  (SEQ ID NO: 568)
```

MYC-1316 Target: 5'-CCATGAGGAGACACCGCCCACCACCAG-3' (SEQ ID NO: 895)

```
          5'-CAUGAGGAGACACCGCCCACCACCA A^A-3'  (SEQ ID NO: 1877)
          3'-GUACUCCUCUGUGGCGGGUGGUGGU C G-5'  (SEQ ID NO: 569)
```

MYC-1317 Target: 5'-CATGAGGAGACACCGCCCACCACCAGC-3' (SEQ ID NO: 896)

```
          5'-AUGAGGAGACACCGCCCACCACCAG A^C-3'  (SEQ ID NO: 1878)
          3'-UACUCCUCUGUGGCGGGUGGUGGUC G U-5'  (SEQ ID NO: 570)
```

MYC-1318 Target: 5'-ATGAGGAGACACCGCCCACCACCAGCA-3' (SEQ ID NO: 897)

```
          5'-UGAGGAGACACCGCCCACCACCAGC C^A-3'  (SEQ ID NO: 1879)
          3'-ACUCCUCUGUGGCGGGUGGUGGUCG U C-5'  (SEQ ID NO: 571)
```

MYC-1319 Target: 5'-TGAGGAGACACCGCCCACCACCAGCAG-3' (SEQ ID NO: 898)

```
          5'-GAGGAGACACCGCCCACCACCAGCA A^A-3'  (SEQ ID NO: 1880)
          3'-CUCCUCUGUGGCGGGUGGUGGUCGU C G-5'  (SEQ ID NO: 572)
```

MYC-1320 Target: 5'-GAGGAGACACCGCCCACCACCAGCAGC-3' (SEQ ID NO: 899)

```
          5'-AGGAGACACCGCCCACCACCAGCAG A^A-3'  (SEQ ID NO: 1881)
          3'-UCCUCUGUGGCGGGUGGUGGUCGUC G C-5'  (SEQ ID NO: 573)
```

MYC-1321 Target: 5'-AGGAGACACCGCCCACCACCAGCAGCG-3' (SEQ ID NO: 900)

TABLE 6-continued

Selected Human Anti-MYC "Blunt/Fray" DsiRNAs

```
              5'-GGAGACACCGCCCACCACCAGCAGC A C-3'     (SEQ ID NO: 1882)
              3'-CCUCUGUGGCGGGUGGUGGUCGUCG C U-5'    (SEQ ID NO: 574)
```

MYC-1322 Target: 5'-GGAGACACCGCCCACCACCAGCAGCGA-3' (SEQ ID NO: 901)

```
              5'-GAGACACCGCCCACCACCAGCAGCG C A-3'    (SEQ ID NO: 1883)
              3'-CUCUGUGGCGGGUGGUGGUCGUCGC U G-5'   (SEQ ID NO: 575)
```

MYC-1323 Target: 5'-GAGACACCGCCCACCACCAGCAGCGAC-3' (SEQ ID NO: 902)

```
              5'-AGACACCGCCCACCACCAGCAGCGA A C-3'   (SEQ ID NO: 1884)
              3'-UCUGUGGCGGGUGGUGGUCGUCGCU G A-5'  (SEQ ID NO: 576)
```

MYC-1324 Target: 5'-AGACACCGCCCACCACCAGCAGCGACT-3' (SEQ ID NO: 903)

```
              5'-GACACCGCCCACCACCAGCAGCGAC C A-3'   (SEQ ID NO: 1885)
              3'-CUGUGGCGGGUGGUGGUCGUCGCUG A G-5'  (SEQ ID NO: 577)
```

MYC-1325 Target: 5'-GACACCGCCCACCACCAGCAGCGACTC-3' (SEQ ID NO: 904)

```
              5'-ACACCGCCCACCACCAGCAGCGACU A C-3'   (SEQ ID NO: 1886)
              3'-UGUGGCGGGUGGUGGUCGUCGCUGA G A-5'  (SEQ ID NO: 578)
```

MYC-1326 Target: 5'-ACACCGCCCACCACCAGCAGCGACTCT-3' 9SEQ ID NO: 905)

```
              5'-CACCGCCCACCACCAGCAGCGACUC C A-3'   (SEQ ID NO: 1887)
              3'-GUGGCGGGUGGUGGUCGUCGCUGAG A C-5'  (SEQ ID NO: 579)
```

MYC-1327 Target: 5'-CACCGCCCACCACCAGCAGCGACTCTG-3' (SEQ ID NO: 906)

```
              5'-ACCGCCCACCACCAGCAGCGACUCU A C-3'   (SEQ ID NO: 1888)
              3'-UGGCGGGUGGUGGUCGUCGCUGAGA C U-5'  (SEQ ID NO: 580)
```

MYC-1328 Target: 5'-ACCGCCCACCACCAGCAGCGACTCTGA-3' (SEQ ID NO: 907)

```
              5'-CCGCCCACCACCAGCAGCGACUCUG C A-3'   (SEQ ID NO: 1889)
              3'-GGCGGGUGGUGGUCGUCGCUGAGAC U C-5'  (SEQ ID NO: 581)
```

MYC-1329 Target: 5'-CCGCCCACCACCAGCAGCGACTCTGAG-3' (SEQ ID NO: 908)

```
              5'-CGCCCACCACCAGCAGCGACUCUGA A A-3'   (SEQ ID NO: 1890)
              3'-GCGGGUGGUGGUCGUCGCUGAGACU C C-5'  (SEQ ID NO: 582)
```

MYC-1330 Target: 5'-CGCCCACCACCAGCAGCGACTCTGAGG-3' (SEQ ID NO: 909)

```
              5'-GCCCACCACCAGCAGCGACUCUGAG A C-3'   (SEQ ID NO: 1891)
              3'-CGGGUGGUGGUCGUCGCUGAGACUC U-5'    (SEQ ID NO: 583)
```

MYC-1331 Target: 5'-GCCCACCACCAGCAGCGACTCTGAGGA-3' (SEQ ID NO: 910)

```
              5'-CCCACCACCAGCAGCGACUCUGAGG C A-3'   (SEQ ID NO: 1892)
              3'-GGGUGGUGGUCGUCGCUGAGACUCC U C-5'  (SEQ ID NO: 584)
```

MYC-1332 Target: 5'-CCCACCACCAGCAGCGACTCTGAGGAG-3' (SEQ ID NO: 911)

TABLE 6-continued

Selected Human Anti-MYC "Blunt/Fray" DsiRNAs

```
               5'-CCACCACCAGCAGCGACUCUGAGGA^AA-3'  (SEQ ID NO: 1893)
               3'-GGUGGUGGUCGUCGCUGAGACUCCU_CC-5'  (SEQ ID NO: 585)
```

MYC-1333 Target: 5'-CCACCACCAGCAGCGACTCTGAGGAGG-3' (SEQ ID NO: 912)

```
               5'-CACCACCAGCAGCGACUCUGAGGAG^AC-3'  (SEQ ID NO: 1894)
               3'-GUGGUGGUCGUCGCUGAGACUCCUC_CU-5'  (SEQ ID NO: 586)
```

MYC-1334 Target: 5'-CACCACCAGCAGCGACTCTGAGGAGGA-3' (SEQ ID NO: 913)

```
               5'-AACAAGAAGAUGAGGAAGAAAUCGA^CA-3'  (SEQ ID NO: 1895)
               3'-UUGUUCUUCUACUCCUUCUUUAGCU_AC-5'  (SEQ ID NO: 587)
```

MYC-1360 Target: 5'-AACAAGAAGATGAGGAAGAAATCGATG-3' (SEQ ID NO: 914)

```
               5'-ACAAGAAGAUGAGGAAGAAAUCGAU^AC-3'  (SEQ ID NO: 1896)
               3'-UGUUCUUCUACUCCUUCUUUAGCUA_CA-5'  (SEQ ID NO: 588)
```

MYC-1361 Target: 5'-ACAAGAAGATGAGGAAGAAATCGATGT-3' (SEQ ID NO: 915)

```
               5'-UGGAGGCCACAGCAAACCUCCUCAC^CA-3'  (SEQ ID NO: 1897)
               3'-ACCUCCGGUGUCGUUUGGAGGAGUG_UC-5'  (SEQ ID NO: 589)
```

MYC-1448 Target: 5'-TGGAGGCCACAGCAAACCTCCTCACAG-3' (SEQ ID NO: 916)

```
               5'-CUCACAGCCCACUGGUCCUCAAGAG^AC-3'  (SEQ ID NO: 1898)
               3'-GAGUGUCGGGUGACCAGGAGUUCUC_CA-5'  (SEQ ID NO: 590)
```

MYC-1468 Target: 5'-CTCACAGCCCACTGGTCCTCAAGAGGT-3' (SEQ ID NO: 917)

```
               5'-UCACAGCCCACUGGUCCUCAAGAGG^CA-3'  (SEQ ID NO: 1899)
               3'-UGUGUCGGGUGACCAGGAGUUCUCC_AC-5'  (SEQ ID NO: 591)
```

MYC-1469 Target: 5'-TCACAGCCCACTGGTCCTCAAGAGGTG-3' (SEQ ID NO: 918)

```
               5'-CACAGCCCACUGGUCCUCAAGAGGU^AA-3'  (SEQ ID NO: 1900)
               3'-GUGUCGGGUGACCAGGAGUUCUCCA_CG-5'  (SEQ ID NO: 592)
```

MYC-1470 Target: 5'-CACAGCCCACTGGTCCTCAAGAGGTGC-3' (SEQ ID NO: 919)

```
               5'-ACAGCCCACUGGUCCUCAAGAGGUG^AA-3'  (SEQ ID NO: 1901)
               3'-UGUCGGGUGACCAGGAGUUCUCCAC_GG-5'  (SEQ ID NO: 593)
```

MYC-1471 Target: 5'-ACAGCCCACTGGTCCTCAAGAGGTGCC-3' (SEQ ID NO: 920)

```
               5'-CAGCCCACUGGUCCUCAAGAGGUGC^AC-3'  (SEQ ID NO: 1902)
               3'-GUCGGGUGACCAGGAGUUCUCCACG_GU-5'  (SEQ ID NO: 594)
```

MYC-1472 Target: 5'-CAGCCCACTGGTCCTCAAGAGGTGCCA-3' (SEQ ID NO: 921)

```
               5'-AGCCCACUGGUCCUCAAGAGGUGCC^CA-3'  (SEQ ID NO: 1903)
               3'-UCGGGUGACCAGGAGUUCUCCACGG_UG-5'  (SEQ ID NO: 595)
```

MYC-1473 Target: 5'-AGCCCACTGGTCCTCAAGAGGTGCCAC-3' (SEQ ID NO: 922)

TABLE 6-continued

Selected Human Anti-MYC "Blunt/Fray" DsiRNAs

```
              5'-GCCCACUGGUCCUCAAGAGGUGCCA^AA-3'   (SEQ ID NO: 1904)
              3'-CGGGUGACCAGGAGUUCUCCACGGU_GC-5'   (SEQ ID NO: 596)
```

MYC-1474 Target: 5'-GCCCACTGGTCCTCAAGAGGTGCCACG-3' (SEQ ID NO: 923)

```
              5'-CCCACUGGUCCUCAAGAGGUGCCAC^AC-3'   (SEQ ID NO: 1905)
              3'-GGGUGACCAGGAGUUCUCCACGGUG_CA-5'   (SEQ ID NO: 597)
```

MYC-1475 Target: 5'-CCCACTGGTCCTCAAGAGGTGCCACGT-3' (SEQ ID NO: 924)

```
              5'-CCACUGGUCCUCAAGAGGUGCCACG^CA-3'   (SEQ ID NO: 1906)
              3'-GGUGACCAGGAGUUCUCCACGGUGC_AG-5'   (SEQ ID NO: 598)
```

MYC-1476 Target: 5'-CCACTGGTCCTCAAGAGGTGCCACGTC-3' (SEQ ID NO: 925)

```
              5'-CACUGGUCCUCAAGAGGUGCCACGU^AC-3'   (SEQ ID NO: 1907)
              3'-GUGACCAGGAGUUCUCCACGGUGCA_GA-5'   (SEQ ID NO: 599)
```

MYC-1477 Target: 5'-CACTGGTCCTCAAGAGGTGCCACGTCT-3' (SEQ ID NO: 926)

```
              5'-ACUGGUCCUCAAGAGGUGCCACGUC^CA-3'   (SEQ ID NO: 1908)
              3'-UGACCAGGAGUUCUCCACGGUGCAG_AG-5'   (SEQ ID NO: 600)
```

MYC-1478 Target: 5'-ACTGGTCCTCAAGAGGTGCCACGTCTC-3' (SEQ ID NO: 927)

```
              5'-CUGGUCCUCAAGAGGUGCCACGUCU^AA-3'   (SEQ ID NO: 1909)
              3'-GACCAGGAGUUCUCCACGGUGCAGA_GG-5'   (SEQ ID NO: 601)
```

MYC-1479 Target: 5'-CTGGTCCTCAAGAGGTGCCACGTCTCC-3' (SEQ ID NO: 928)

```
              5'-UGGUCCUCAAGAGGUGCCACGUCUC^AC-3'   (SEQ ID NO: 1910)
              3'-ACCAGGAGUUCUCCACGGUGCAGAG_GU-5'   (SEQ ID NO: 602)
```

MYC-1480 Target: 5'-TGGTCCTCAAGAGGTGCCACGTCTCCA-3' (SEQ ID NO: 929)

```
              5'-GGUCCUCAAGAGGUGCCACGUCUCC^CA-3'   (SEQ ID NO: 1911)
              3'-CCAGGAGUUCUCCACGGUGCAGAGG_UG-5'   (SEQ ID NO: 603)
```

MYC-1481 Target: 5'-GGTCCTCAAGAGGTGCCACGTCTCCAC-3' (SEQ ID NO: 930)

```
              5'-GUCCUCAAGAGGUGCCACGUCUCCA^AC-3'   (SEQ ID NO: 1912)
              3'-CAGGAGUUCUCCACGGUGCAGAGGU_GU-5'   (SEQ ID NO: 604)
```

MYC-1482 Target: 5'-GTCCTCAAGAGGTGCCACGTCTCCACA-3' (SEQ ID NO: 931)

```
              5'-UCCUCAAGAGGUGCCACGUCUCCAC^CA-3'   (SEQ ID NO: 1913)
              3'-AGGAGUUCUCCACGGUGCAGAGGUG_UG-5'   (SEQ ID NO: 605)
```

MYC-1483 Target: 5'-TCCTCAAGAGGTGCCACGTCTCCACAC-3' (SEQ ID NO: 932)

```
              5'-GGAGCUUUUUUGCCCUGCGUGACCA^AC-3'   (SEQ ID NO: 1914)
              3'-CCUCGAAAAAACGGGACGCACUGGU_CU-5'   (SEQ ID NO: 606)
```

MYC-1711 Target: 5'-GGAGCTTTTTTGCCCTGCGTGACCAGA-3' (SEQ ID NO: 933)

TABLE 6-continued

Selected Human Anti-MYC "Blunt/Fray" DsiRNAs

```
                5'-GAGCUUUUUGCCCUGCGUGACCAG^C C-3'        (SEQ ID NO: 1915)
                3'-CUCGAAAAAACGGGACGCACUGGUC U_A-5'       (SEQ ID NO: 607)

MYC-1712 Target: 5'-GAGCTTTTTGCCCTGCGTGACCAGAT-3'         (SEQ ID NO: 934)

5'-AGCUUUUUGCCCUGCGUGACCAGA^C A-3'        (SEQ ID NO: 1916)
                3'-UCGAAAAAACGGGACGCACUGGUCU_A G-5'       (SEQ ID NO: 608)

MYC-1713 Target: 5'-AGCTTTTTGCCCTGCGTGACCAGATC-3'         (SEQ ID NO: 935)

5'-GCUUUUUGCCCUGCGUGACCAGAU^A A-3'        (SEQ ID NO: 1917)
                3'-CGAAAAAACGGGACGCACUGGUCUA_G G-5'       (SEQ ID NO: 609)

MYC-1714 Target: 5'-GCTTTTTGCCCTGCGTGACCAGATCC-3'         (SEQ ID NO: 936)

5'-CUUUUUGCCCUGCGUGACCAGAUC^A A-3'        (SEQ ID NO: 1918)
                3'-GAAAAAACGGGACGCACUGGUCUAG_G G-5'       (SEQ ID NO: 610)

MYC-1715 Target: 5'-CTTTTTGCCCTGCGTGACCAGATCCC-3'         (SEQ ID NO: 937)

5'-UUUUUGCCCUGCGUGACCAGAUCC^A A-3'        (SEQ ID NO: 1919)
                3'-AAAAACGGGACGCACUGGUCUAGG_G C-5'        (SEQ ID NO: 611)

MYC-1716 Target: 5'-TTTTTGCCCTGCGTGACCAGATCCCG-3'         (SEQ ID NO: 938)

5'-UUUUGCCCUGCGUGACCAGAUCCC^A A-3'        (SEQ ID NO: 1920)
                3'-AAAAACGGGACGCACUGGUCUAGGG_C C-5'       (SEQ ID NO: 612)

MYC-1717 Target: 5'-TTTTGCCCTGCGTGACCAGATCCCGG-3'         (SEQ ID NO: 939)

5'-UUUUGCCCUGCGUGACCAGAUCCCG^A C-3'       (SEQ ID NO: 1921)
                3'-AAAACGGGACGCACUGGUCUAGGGC_C U-5'       (SEQ ID NO: 613)

MYC-1718 Target: 5'-TTTTGCCCTGCGTGACCAGATCCCGGA-3'        (SEQ ID NO: 940)

5'-UUUGCCCUGCGUGACCAGAUCCCGG^C A-3'       (SEQ ID NO: 1922)
                3'-AAACGGGACGCACUGGUCUAGGGCC_U C-5'       (SEQ ID NO: 614)

MYC-1719 Target: 5'-TTTGCCCTGCGTGACCAGATCCCGGAG-3'        (SEQ ID NO: 941)

5'-UUGCCCUGCGUGACCAGAUCCCGGA^A C-3'       (SEQ ID NO: 1923)
                3'-AACGGGACGCACUGGUCUAGGGCCU_C A-5'       (SEQ ID NO: 615)

MYC-1720 Target: 5'-TTGCCCTGCGTGACCAGATCCCGGAGT-3'        (SEQ ID NO: 942)

5'-UGCCCUGCGUGACCAGAUCCCGGAG^C C-3'       (SEQ ID NO: 1924)
                3'-ACGGGACGCACUGGUCUAGGGCCUC_A A-5'       (SEQ ID NO: 616)

MYC-1721 Target: 5'-TGCCCTGCGTGACCAGATCCCGGAGTT-3'        (SEQ ID NO: 943)

5'-GCGGAAACGACGAGAACAGUUGAAA^A C-3'       (SEQ ID NO: 1925)
                3'-CGCCUUUGCUGCUCUUGUCAACUUU_G U-5'       (SEQ ID NO: 617)

MYC-1856 Target: 5'-GCGGAAACGACGAGAACAGTTGAAACA-3'        (SEQ ID NO: 944)
```

TABLE 6-continued

Selected Human Anti-MYC "Blunt/Fray" DsiRNAs

```
              5'-CGGAAACGACGAGAACAGUUGAAAC C^A-3'    (SEQ ID NO: 1926)
              3'-GCCUUUGCUGCUCUUGUCAACUUUG U_G-5'    (SEQ ID NO: 618)
```

MYC-1857 Target: 5'-CGGAAACGACGAGAACAGTTGAAACAC-3'  (SEQ ID NO: 945)

```
              5'-UCUUUAACAGAUUUGUAUUUAAGAA C^C-3'   (SEQ ID NO: 1927)
              3'-AGAAAUUGUCUAAACAUAAAUUCUU A_A-5'   (SEQ ID NO: 619)
```

MYC-2115 Target: 5'-TCTTTAACAGATTTGTATTTAAGAATT-3'  (SEQ ID NO: 946)

```
              5'-CUUUAACAGAUUUGUAUUUAAGAAU C^A-3'   (SEQ ID NO: 1928)
              3'-GAAAUUGUCUAAACAUAAAUUCUUA A_C-5'   (SEQ ID NO: 620)
```

MYC-2116 Target: 5'-CTTTAACAGATTTGTATTTAAGAATTG-3'  (SEQ ID NO: 947)

```
              5'-UUAAAUGUAAAUAACUUUAAUAAAA A^A-3'   (SEQ ID NO: 1929)
              3'-AAUUUACAUUUAUUGAAAUUAUUUU G_C-5'   (SEQ ID NO: 621)
```

MYC-2193 Target: 5'-TTAAATGTAAATAACTTTAATAAAACG-3'  (SEQ ID NO: 948)

```
              5'-UAAAUGUAAAUAACUUUAAUAAAAC A^C-3'   (SEQ ID NO: 1930)
              3'-AUUUACAUUUAUUGAAAUUAUUUUG C_A-5'   (SEQ ID NO: 622)
```

MYC-2194 Target: 5'-TAAATGTAAATAACTTTAATAAAACGT-3'  (SEQ ID NO: 949)

```
              5'-AAAUGUAAAUAACUUUAAUAAAACG C^C-3'   (SEQ ID NO: 1931)
              3'-UUUACAUUUAUUGAAAUUAUUUUGC A_A-5'   (SEQ ID NO: 623)
```

MYC-2195 Target: 5'-AAATGTAAATAACTTTAATAAAACGTT-3'  (SEQ ID NO: 950)

```
              5'-AAUGUAAAUAACUUUAAUAAAACGU C^C-3'   (SEQ ID NO: 1932)
              3'-UUACAUUUAUUGAAAUUAUUUUGCA A_A-5'   (SEQ ID NO: 624)
```

MYC-2196 Target: 5'-AATGTAAATAACTTTAATAAAACGTTT-3'  (SEQ ID NO: 951)

```
              5'-AUGUAAAUAACUUUAAUAAAACGUU C^C-3'   (SEQ ID NO: 1933)
              3'-UACAUUUAUUGAAAUUAUUUUGCAA A_U-5'   (SEQ ID NO: 625)
```

MYC-2197 Target: 5'-ATGTAAATAACTTTAATAAAACGTTTA-3'  (SEQ ID NO: 952)

```
              5'-UGUAAAUAACUUUAAUAAAACGUUU C^C-3'   (SEQ ID NO: 1934)
              3'-ACAUUUAUUGAAAUUAUUUUGCAAA U_A-5'   (SEQ ID NO: 626)
```

MYC-2198 Target: 5'-TGTAAATAACTTTAATAAAACGTTTAT-3'  (SEQ ID NO: 953)

```
              5'-GUAAAUAACUUUAAUAAAACGUUUA C^C-3'   (SEQ ID NO: 1935)
              3'-CAUUUAUUGAAAUUAUUUUGCAAAU A_U-5'   (SEQ ID NO: 627)
```

MYC-2199 Target: 5'-GTAAATAACTTTAATAAAACGTTTATA-3'  (SEQ ID NO: 954)

```
              5'-UAAAUAACUUUAAUAAAACGUUUAU C^A-3'   (SEQ ID NO: 1936)
              3'-AUUUAUUGAAAUUAUUUUGCAAAUA U_C-5'   (SEQ ID NO: 628)
```

MYC-2200 Target: 5'-TAAATAACTTTAATAAAACGTTTATAG-3'  (SEQ ID NO: 955)

TABLE 6-continued

Selected Human Anti-MYC "Blunt/Fray" DsiRNAs

```
            5'-AAAUAACUUUAAUAAAACGUUUAUA A-3'    (SEQ ID NO: 1937)
                                        A
            3'-UUUAUUGAAAUUAUUUUGCAAAUAU   -5'   (SEQ ID NO: 629)
                                        C
                                         G
```

MYC-2201 Target: 5'-AAATAACTTTAATAAAACGTTTATAGC-3'  (SEQ ID NO: 956)

```
            5'-AAUAACUUUAAUAAAACGUUUAUAG  C-3'   (SEQ ID NO: 1938)
                                         A
            3'-UUAUUGAAAUUAUUUUGCAAAUAUC   -5'   (SEQ ID NO: 630)
                                         G
                                          U
```

MYC-2202 Target: 5'-AATAACTTTAATAAAACGTTTATAGCA-3'  (SEQ ID NO: 957)

```
            5'-AUAACUUUAAUAAAACGUUUAUAGC  A-3'   (SEQ ID NO: 1939)
                                         C
            3'-UAUUGAAAUUAUUUUGCAAAUAUCG   -5'   (SEQ ID NO: 631)
                                         U
                                          C
```

MYC-2203 Target: 5'-ATAACTTTAATAAAACGTTTATAGCAG-3'  (SEQ ID NO: 958)

```
            5'-UAACUUUAAUAAAACGUUUAUAGCA  C-3'   (SEQ ID NO: 1940)
                                         A
            3'-AUUGAAAUUAUUUUGCAAAUAUCGU   -5'   (SEQ ID NO: 632)
                                         C
                                          A
```

MYC-2204 Target: 5'-TAACTTTAATAAAACGTTTATAGCAGT-3'  (SEQ ID NO: 959)

```
            5'-AACUUUAAUAAAACGUUUAUAGCAG C C-3'   (SEQ ID NO: 1941)
            3'-UUGAAAUUAUUUUGCAAAUAUCGUC A-5'    (SEQ ID NO: 633)
                                         A
```

MYC-2205 Target: 5'-AACTTTAATAAAACGTTTATAGCAGTT-3'  (SEQ ID NO: 960)

```
            5'-GCUUUUUAAAGUUGAUUUUUUUCUA C C-3'   (SEQ ID NO: 1942)
            3'-CGAAAAAUUUCAACUAAAAAAACAU A-5'    (SEQ ID NO: 634)
                                         A
```

MYC-2313 Target: 5'-GCTTTTTAAAGTTGATTTTTTCTATT-3'  (SEQ ID NO: 961)

```
            5'-CUUUUUAAAGUUGAUUUUUUUCUAU  A-3'   (SEQ ID NO: 1943)
                                         C
            3'-GAAAAAUUUCAACUAAAAAAAGAUA   -5'   (SEQ ID NO: 635)
                                         A
                                          C
```

MYC-2314 Target: 5'-CTTTTTAAAGTTGATTTTTTCTATTG-3'  (SEQ ID NO: 962)

```
            5'-UUUUUAAAGUUGAUUUUUUUCUAUU A C-3'   (SEQ ID NO: 1944)
            3'-AAAAAUUUCAACUAAAAAAAGAUAA C-5'    (SEQ ID NO: 636)
                                         A
```

MYC-2315 Target: 5'-TTTTTAAAGTTGATTTTTTCTATTGT-3'  (SEQ ID NO: 963)

```
            5'-UUUUAAAGUUGAUUUUUUUCUAUUG  C-3'   (SEQ ID NO: 1945)
                                         C
            3'-AAAAUUUCAACUAAAAAAAGAUAAC   -5'   (SEQ ID NO: 637)
                                         A
                                          A
```

MYC-2316 Target: 5'-TTTTAAAGTTGATTTTTTCTATTGTT-3'  (SEQ ID NO: 964)

```
            5'-UUUAAAGUUGAUUUUUUUCUAUUGU  C-3'   (SEQ ID NO: 1946)
                                         C
            3'-AAAUUUCAACUAAAAAAAGAUAACA   -5'   (SEQ ID NO: 638)
                                         A
                                          A
```

MYC-2317 Target: 5'-TTTAAAGTTGATTTTTTCTATTGTTT-3'  (SEQ ID NO: 965)

```
            5'-UUAAAGUUGAUUUUUUUCUAUUGUU  C-3'   (SEQ ID NO: 1947)
                                         C
            3'-AAUUUCAACUAAAAAAAGAUAACAA   -5'   (SEQ ID NO: 639)
                                         A
                                          A
```

MYC-2318 Target: 5'-TTAAAGTTGATTTTTTCTATTGTTTT-3'  (SEQ ID NO: 966)

TABLE 6-continued

Selected Human Anti-MYC "Blunt/Fray" DsiRNAs

```
              5'-UAAAGUUGAUUUUUUCUAUUGUUU CC-3'    (SEQ ID NO: 1948)
              3'-AUUUCAACUAAAAAAGAUAACAAA AA-5'    (SEQ ID NO: 640)

MYC-2319 Target: 5'-TAAAGTTGATTTTTTCTATTGTTTTT-3' (SEQ ID NO: 967)

5'-AAAGUUGAUUUUUUCUAUUGUUUU CC-3'    (SEQ ID NO: 1949)
              3'-UUUCAACUUUUUUUGAUAACAAAA AU-5'    (SEQ ID NO: 641)

MYC-2320 Target: 5'-AAAGTTGATTTTTTCTATTGTTTTA-3' (SEQ ID NO: 968)

5'-AAGUUGAUUUUUUCUAUUGUUUUU CA-3'    (SEQ ID NO: 1950)
              3'-UUCAACUAAAAAAGAUAACAAAAA UC-5'    (SEQ ID NO: 642)

MYC-2321 Target: 5'-AAGTTGATTTTTTCTATTGTTTTAG-3' (SEQ ID NO: 969)

5'-AGUUGAUUUUUUCUAUUGUUUUUA AC-3'    (SEQ ID NO: 1951)
              3'-UCAACUAAAAAAGAUAACAAAAAU CU-5'    (SEQ ID NO: 643)

MYC-2322 Target: 5'-AGTTGATTTTTTCTATTGTTTTAGA-3' (SEQ ID NO: 970)

5'-GUUGAUUUUUUCUAUUGUUUUUAG CC-3'    (SEQ ID NO: 1952)
              3'-CAACUAAAAAAGAUAACAAAAAUC UU-5'    (SEQ ID NO: 644)

MYC-2323 Target: 5'-GTTGATTTTTTCTATTGTTTTAGAA-3' (SEQ ID NO: 971)

5'-UUGAUUUUUUCUAUUGUUUUUAGA CC-3'    (SEQ ID NO: 1953)
              3'-AACUAAAAAAGAUAACAAAAAUCU UU-5'    (SEQ ID NO: 645)

MYC-2324 Target: 5'-TTGATTTTTTCTATTGTTTTAGAAA-3' (SEQ ID NO: 972)

5'-UGAUUUUUUCUAUUGUUUUUAGAA CC-3'    (SEQ ID NO: 1954)
              3'-ACUAAAAAAGAUAACAAAAAUCUU UU-5'    (SEQ ID NO: 646)

MYC-2325 Target: 5'-TGATTTTTTCTATTGTTTTAGAAAA-3' (SEQ ID NO: 973)

5'-GAUUUUUUCUAUUGUUUUUAGAAA CC-3'    (SEQ ID NO: 1955)
              3'-CUAAAAAAGAUAACAAAAAUCUUU UU-5'    (SEQ ID NO: 647)

MYC-2326 Target: 5'-GATTTTTTCTATTGTTTTAGAAAAA-3' (SEQ ID NO: 974)

5'-AUUUUUUCUAUUGUUUUUAGAAAA CC-3'    (SEQ ID NO: 1956)
              3'-UAAAAAAGAUAACAAAAAUCUUUU UU-5'    (SEQ ID NO: 648)

MYC-2327 Target: 5'-ATTTTTTCTATTGTTTTAGAAAAAA-3' (SEQ ID NO: 975)

5'-UUUUUUCUAUUGUUUUUAGAAAAA CC-3'    (SEQ ID NO: 1957)
              3'-AAAAAAGAUAACAAAAAUCUUUUU UA-5'    (SEQ ID NO: 649)

MYC-2328 Target: 5'-TTTTTTCTATTGTTTTAGAAAAAAT-3' (SEQ ID NO: 976)

5'-UUUUUCUAUUGUUUUUAGAAAAAA CC-3'    (SEQ ID NO: 1958)
              3'-AAAAAAGAUAACAAAAAUCUUUUU AU-5'    (SEQ ID NO: 650)

MYC-2329 Target: 5'-TTTTTCTATTGTTTTAGAAAAAATA-3' (SEQ ID NO: 977)
```

TABLE 6-continued

Selected Human Anti-MYC "Blunt/Fray" DsiRNAs

```
                5'-UUUUUCUAUUGUUUUUAGAAAAAAU C^C-3'   (SEQ ID NO: 1959)
                3'-AAAAAGAUAACAAAAAUCUUUUUUA U_U-5'   (SEQ ID NO: 651)

MYC-2330 Target: 5'-TTTTTCTATTGTTTTTAGAAAAAATAA-3'    (SEQ ID NO: 978)

5'-UUUUCUAUUGUUUUUAGAAAAAAUA C^C-3'   (SEQ ID NO: 1960)
                3'-AAAAGAUAACAAAAAUCUUUUUUAU U_U-5'   (SEQ ID NO: 652)

MYC-2331 Target: 5'-TTTTCTATTGTTTTTAGAAAAAATAAA-3'   (SEQ ID NO: 979)

5'-UUUCUAUUGUUUUUAGAAAAAAUAA C^C-3'   (SEQ ID NO: 1961)
                3'-AAAGAUAACAAAAAUCUUUUUUAUU U_U-5'   (SEQ ID NO: 653)

MYC-2332 Target: 5'-TTTCTATTGTTTTTAGAAAAAATAAAA-3'   (SEQ ID NO: 980)

5'-UUCUAUUGUUUUUAGAAAAAAUAAA C^C-3'   (SEQ ID NO: 1962)
                3'-AAGAUAACAAAAAUCUUUUUUAUUU U_A-5'   (SEQ ID NO: 654)

MYC-2333 Target: 5'-TTCTATTGTTTTTAGAAAAAATAAAT-3'    (SEQ ID NO: 981)
```

TABLE 7

Selected Human Anti-MYC "Blunt/Blunt" DsiRNAs

```
                5'-CUCGAGAAGGGCAGGGCUUCUCAGAGG-3'    (SEQ ID NO: 1963)
                3'-GAGCUCUUCCCGUCCCGAAGAGUCUCC-5'    (SEQ ID NO: 328)
MYC-94 Target:  5'-CTCGAGAAGGGCAGGGCTTCTCAGAGG-3'    (SEQ ID NO: 655)

5'-GGGCUUUAUCUAACUCGCUGUAGUAAU-3'    (SEQ ID NO: 1964)
                3'-CCCGAAAUAGAUUGAGCGACAUCAUUA-5'    (SEQ ID NO: 329)
MYC-178 Target: 5'-GGGCTTTATCTAACTCGCTGTAGTAAT-3'    (SEQ ID NO: 656)

5'-AACCCUUGCCGCAUCCACGAAACUUUG-3'    (SEQ ID NO: 1965)
                3'-UUGGGAACGGCGUAGGUGCUUUGAAAC-5'    (SEQ ID NO: 330)
MYC-365 Target: 5'-AACCCTTGCCGCATCCACGAAACTTTG-3'    (SEQ ID NO: 657)

5'-UUGCCGCAUCCACGAAACUUUGCCCAU-3'    (SEQ ID NO: 1966)
                3'-AACGGCGUAGGUGCUUUGAAACGGGUA-5'    (SEQ ID NO: 331)
MYC-370 Target: 5'-TTGCCGCATCCACGAAACTTTGCCCAT-3'    (SEQ ID NO: 658)

5'-CAUCCACGAAACUUUGCCCAUAGCAGC-3'    (SEQ ID NO: 1967)
                3'-GUAGGUGCUUUGAAACGGGUAUCGUCG-5'    (SEQ ID NO: 332)
MYC-376 Target: 5'-CATCCACGAAACTTTGCCCATAGCAGC-3'    (SEQ ID NO: 659)

5'-GGGCGGGCACUUUGCACUGGAACUUAC-3'    (SEQ ID NO: 1968)
                3'-CCCGCCCGUGAAACGUGACCUUGAAUG-5'    (SEQ ID NO: 333)
MYC-403 Target: 5'-GGGCGGGCACTTTGCACTGGAACTTAC-3'    (SEQ ID NO: 660)

5'-GCACUUUGCACUGGAACUUACAACACC-3'    (SEQ ID NO: 1969)
                3'-CGUGAAACGUGACCUUGAAUGUUGUGG-5'    (SEQ ID NO: 334)
MYC-409 Target: 5'-GCACTTTGCACTGGAACTTACAACACC-3'    (SEQ ID NO: 661)
```

TABLE 7-continued

Selected Human Anti-MYC "Blunt/Blunt" DsiRNAs

```
                           5'-CACUGGAACUUACAACACCCGAGCAAG-3'  (SEQ ID NO: 1970)
                           3'-GUGACCUUGAAUGUUGUGGGCUCGUUC-5'  (SEQ ID NO: 335)
MYC-417 Target:            5'-CACTGGAACTTACAACACCCGAGCAAG-3'  (SEQ ID NO: 662)

5'-UUGCAGCUGCUUAGACGCUGGAUUUUU-3'  (SEQ ID NO: 1971)
                           3'-AACGUCGACGAAUCUGCGACCUAAAAA-5'  (SEQ ID NO: 336)
MYC-535 Target:            5'-TTGCAGCTGCTTAGACGCTGGATTTTT-3'  (SEQ ID NO: 663)

5'-CUGCUUAGACGCUGGAUUUUUUCGGG-3'   (SEQ ID NO: 1972)
                           3'-GACGAAUCUGCGACCUAAAAAAGCCC-5'   (SEQ ID NO: 337)
MYC-541 Target:            5'-CTGCTTAGACGCTGGATTTTTTCGGG-3'   (SEQ ID NO: 664)

5'-GACGCUGGAUUUUUUCGGGUAGUGGA-3'   (SEQ ID NO: 1973)
                           3'-CUGCGACCUAAAAAAGCCCAUCACCU-5'   (SEQ ID NO: 338)
MYC-548 Target:            5'-GACGCTGGATTTTTTCGGGTAGTGGA-3'   (SEQ ID NO: 665)

5'-UGGAUUUUUUCGGGUAGUGGAAAACC-3'   (SEQ ID NO: 1974)
                           3'-ACCUAAAAAAGCCCAUCACCUUUUGG-5'   (SEQ ID NO: 339)
MYC-553 Target:            5'-TGGATTTTTTCGGGTAGTGGAAAACC-3'   (SEQ ID NO: 666)

5'-UUCGGGUAGUGGAAAACCAGCAGCCUC-3'  (SEQ ID NO: 1975)
                           3'-AAGCCCAUCACCUUUUGGUCGUCGGAG-5'  (SEQ ID NO: 340)
MYC-562 Target:            5'-TTCGGGTAGTGGAAAACCAGCAGCCTC-3'  (SEQ ID NO: 667)

5'-CCCUCAACGUUAGCUUCACCAACAGGA-3'  (SEQ ID NO: 1976)
                           3'-GGGAGUUGCAAUCGAAGUGGUUGUCCU-5'  (SEQ ID NO: 341)
MYC-601 Target:            5'-CCCTCAACGTTAGCTTCACCAACAGGA-3'  (SEQ ID NO: 668)

5'-ACGUUAGCUUCACCAACAGGAACUAUG-3'  (SEQ ID NO: 1977)
                           3'-UGCAAUCGAAGUGGUUGUCCUUGAUAC-5'  (SEQ ID NO: 342)
MYC-607 Target:            5'-ACGTTAGCTTCACCAACAGGAACTATG-3'  (SEQ ID NO: 669)

5'-ACGACUCGGUGCAGCCGUAUUUCUACU-3'  (SEQ ID NO: 1978)
                           3'-UGCUGAGCCACGUCGGCAUAAAGAUGA-5'  (SEQ ID NO: 343)
MYC-643 Target:            5'-ACGACTCGGTGCAGCCGTATTTCTACT-3'  (SEQ ID NO: 670)

5'-GUGCAGCCGUAUUUCUACUGCGACGAG-3'  (SEQ ID NO: 1979)
                           3'-CACGUCGGCAUAAAGAUGACGCUGCUC-5'  (SEQ ID NO: 344)
MYC-651 Target:            5'-GTGCAGCCGTATTTCTACTGCGACGAG-3'  (SEQ ID NO: 671)

5'-AGGAGGAGAACUUCUACCAGCAGCAGC-3'  (SEQ ID NO: 1980)
                           3'-UCCUCCUCUUGAAGAUGGUCGUCGUCG-5'  (SEQ ID NO: 345)
MYC-676 Target:            5'-AGGAGGAGAACTTCTACCAGCAGCAGC-3'  (SEQ ID NO: 672)

5'-CAGCGAGGAUAUCUGGAAGAAAUUCGA-3'  (SEQ ID NO: 1981)
                           3'-GUCGCUCCUAUAGACCUUCUUUAAGCU-5'  (SEQ ID NO: 346)
MYC-731 Target:            5'-CAGCGAGGATATCTGGAAGAAATTCGA-3'  (SEQ ID NO: 673)

5'-UACGUUGCGGUCACACCCUUCUCCCUU-3'  (SEQ ID NO: 1982)
                           3'-AUGCAACGCCAGUGUGGGAAGAGGGAA-5'  (SEQ ID NO: 347)
MYC-816 Target:            5'-TACGTTGCGGTCACACCCTTCTCCCTT-3'  (SEQ ID NO: 674)
```

TABLE 7-continued

Selected Human Anti-MYC "Blunt/Blunt" DsiRNAs

|  |  |  |
|---|---|---|
|  | 5'-AGACAUGGUGAACCAGAGUUUCAUCUG-3' | (SEQ ID NO: 1983) |
|  | 3'-UCUGUACCACUUGGUCUCAAAGUAGAC-5' | (SEQ ID NO: 348) |
| MYC-920 Target: | 5'-AGACATGGTGAACCAGAGTTTCATCTG-3' | (SEQ ID NO: 675) |
|  | 5'-ACCCGGACGACGAGACCUUCAUCAAAA-3' | (SEQ ID NO: 1984) |
|  | 3'-UGGGCCUGCUGCUCUGGAAGUAGUUUU-5' | (SEQ ID NO: 349) |
| MYC-949 Target: | 5'-ACCCGGACGACGAGACCTTCATCAAAA-3' | (SEQ ID NO: 676) |
|  | 5'-ACGAGACCUUCAUCAAAAACAUCAUCA-3' | (SEQ ID NO: 1985) |
|  | 3'-UGCUCUGGAAGUAGUUUUGUAGUAGU-5' | (SEQ ID NO: 350) |
| MYC-958 Target: | 5'-ACGAGACCTTCATCAAAAACATCATCA-3' | (SEQ ID NO: 677) |
|  | 5'-UCAAAAACAUCAUCAUCCAGGACUGUA-3' | (SEQ ID NO: 1986) |
|  | 3'-AGUUUUUGUAGUAGUAGGUCCUGACAU-5' | (SEQ ID NO: 351) |
| MYC-970 Target: | 5'-TCAAAAACATCATCATCCAGGACTGTA-3' | (SEQ ID NO: 678) |
|  | 5'-CAGGACUGUAUGUGGAGCGGCUUCUCG-3' | (SEQ ID NO: 1987) |
|  | 3'-GUCCUGACAUACACCUCGCCGAAGAGC-5' | (SEQ ID NO: 352) |
| MYC-987 Target: | 5'-CAGGACTGTATGTGGAGCGGCTTCTCG-3' | (SEQ ID NO: 679) |
|  | 5'-GUCUGCUCCACCUCCAGCUUGUACCUG-3' | (SEQ ID NO: 1988) |
|  | 3'-CAGACGAGGUGGAGGUCGAACAUGGAC-5' | (SEQ ID NO: 353) |
| MYC-1104 Target: | 5'-GTCTGCTCCACCTCCAGCTTGTACCTG-3' | (SEQ ID NO: 680) |
|  | 5'-CCACCUCCAGCUUGUACCUGCAGGAUC-3' | (SEQ ID NO: 1989) |
|  | 3'-GGUGGAGGUCGAACAUGGACGUCCUAG-5' | (SEQ ID NO: 354) |
| MYC-1111 Target: | 5'-CCACCTCCAGCTTGTACCTGCAGGATC-3' | (SEQ ID NO: 681) |
|  | 5'-UCCAGCUUGUACCUGCAGGAUCUGAGC-3' | (SEQ ID NO: 1990) |
|  | 3'-AGGUCGAACAUGGACGUCCUAGACUCG-5' | (SEQ ID NO: 355) |
| MYC-1116 Target: | 5'-TCCAGCTTGTACCTGCAGGATCTGAGC-3' | (SEQ ID NO: 682) |
|  | 5'-CCAAGUCCUGCGCCUCGCAAGACUCCA-3' | (SEQ ID NO: 1991) |
|  | 3'-GGUUCAGGACGCGGAGCGUUCUGAGGU-5' | (SEQ ID NO: 356) |
| MYC-1210 Target: | 5'-CCAAGTCCTGCGCCTCGCAAGACTCCA-3' | (SEQ ID NO: 683) |
|  | 5'-CAGCAGCGACUCUGAGGAGGAACAAGA-3' | (SEQ ID NO: 1992) |
|  | 3'-GUCGUCGCUGAGACUCCUCCUUGUUCU-5' | (SEQ ID NO: 357) |
| MYC-1340 Target: | 5'-CAGCAGCGACTCTGAGGAGGAACAAGA-3' | (SEQ ID NO: 684) |
|  | 5'-CGACUCUGAGGAGGAACAAGAAGAUGA-3' | (SEQ ID NO: 1993) |
|  | 3'-GCUGAGACUCCUCCUUGUUCUUCUACU-5' | (SEQ ID NO: 358) |
| MYC-1346 Target: | 5'-CGACTCTGAGGAGGAACAAGAAGATGA-3' | (SEQ ID NO: 685) |
|  | 5'-CUGAGGAGGAACAAGAAGAUGAGGAAG-3' | (SEQ ID NO: 1994) |
|  | 3'-GACUCCUCCUUGUUCUUCUACUCCUUC-5' | (SEQ ID NO: 359) |
| MYC-1351 Target: | 5'-CTGAGGAGGAACAAGAAGATGAGGAAG-3' | (SEQ ID NO: 686) |
|  | 5'-GGAACAAGAAGAUGAGGAAGAAAUCGA-3' | (SEQ ID NO: 1995) |
|  | 3'-CCUUGUUCUUCUACUCCUUCUUUAGCU-5' | (SEQ ID NO: 360) |
| MYC-1358 Target: | 5'-GGAACAAGAAGATGAGGAAGAAATCGA-3' | (SEQ ID NO: 687) |

TABLE 7-continued

Selected Human Anti-MYC "Blunt/Blunt" DsiRNAs

```
                   5'-AGAAGAUGAGGAAGAAAUCGAUGUUGU-3'      (SEQ ID NO: 1996)
                   3'-UCUUCUACUCCUUCUUUAGCUACAACA-5'      (SEQ ID NO: 361)
MYC-1364 Target:   5'-AGAAGATGAGGAAGAAATCGATGTTGT-3'      (SEQ ID NO: 688)
                   5'-UGAGGAAGAAAUCGAUGUUGUUUCUGU-3'      (SEQ ID NO: 1997)
                   3'-ACUCCUUCUUUAGCUACAACAAAGACA-5'      (SEQ ID NO: 362)
MYC-1370 Target:   5'-TGAGGAAGAAATCGATGTTGTTTCTGT-3'      (SEQ ID NO: 689)
                   5'-AGAAAUCGAUGUUGUUUCUGUGGAAAA-3'      (SEQ ID NO: 1998)
                   3'-UCUUUAGCUACAACAAAGACACCUUUU-5'      (SEQ ID NO: 363)
MYC-1376 Target:   5'-AGAAATCGATGTTGTTTCTGTGGAAAA-3'      (SEQ ID NO: 690)
                   5'-CGAUGUUGUUUCUGUGGAAAAGAGGCA-3'      (SEQ ID NO: 1999)
                   3'-GCUACAACAAAGACACCUUUUCUCCGU-5'      (SEQ ID NO: 364)
MYC-1382 Target:   5'-CGATGTTGTTTCTGTGGAAAAGAGGCA-3'      (SEQ ID NO: 691)
                   5'-AAGAGGCAGGCUCCUGGCAAAAGGUCA-3'      (SEQ ID NO: 2000)
                   3'-UUCUCCGUCCGAGGACCGUUUUCCAGU-5'      (SEQ ID NO: 365)
MYC-1401 Target:   5'-AAGAGGCAGGCTCCTGGCAAAAGGTCA-3'      (SEQ ID NO: 692)
                   5'-GCAGGCUCCUGGCAAAAGGUCAGAGUC-3'      (SEQ ID NO: 2001)
                   3'-CGUCCGAGGACCGUUUUCCAGUCUCAG-5'      (SEQ ID NO: 366)
MYC-1406 Target:   5'-GCAGGCTCCTGGCAAAAGGTCAGAGTC-3'      (SEQ ID NO: 693)
                   5'-CUCCUGGCAAAAGGUCAGAGUCUGGAU-3'      (SEQ ID NO: 2002)
                   3'-GAGGACCGUUUUCCAGUCUCAGACCUA-5'      (SEQ ID NO: 367)
MYC-1411 Target:   5'-CTCCTGGCAAAAGGTCAGAGTCTGGAT-3'      (SEQ ID NO: 694)
                   5'-GGCAAAAGGUCAGAGUCUGGAUCACCU-3'      (SEQ ID NO: 2003)
                   3'-CCGUUUUCCAGUCUCAGACCUAGUGGA-5'      (SEQ ID NO: 368)
MYC-1416 Target:   5'-GGCAAAAGGTCAGAGTCTGGATCACCT-3'      (SEQ ID NO: 695)
                   5'-AAGGUCAGAGUCUGGAUCACCUUCUGC-3'      (SEQ ID NO: 2004)
                   3'-UUCCAGUCUCAGACCUAGUGGAAGACG-5'      (SEQ ID NO: 369)
MYC-1421 Target:   5'-AAGGTCAGAGTCTGGATCACCTTCTGC-3'      (SEQ ID NO: 696)
                   5'-CAGCAAACCUCCUCACAGCCCACUGGU-3'      (SEQ ID NO: 2005)
                   3'-GUCGUUUGGAGGAGUGUCGGGUGACCA-5'      (SEQ ID NO: 370)
MYC-1457 Target:   5'-CAGCAAACCTCCTCACAGCCCACTGGT-3'      (SEQ ID NO: 697)
                   5'-CUCCUCACAGCCCACUGGUCCUCAAGA-3'      (SEQ ID NO: 2006)
                   3'-GAGGAGUGUCGGGUGACCAGGAGUUCU-5'      (SEQ ID NO: 371)
MYC-1465 Target:   5'-CTCCTCACAGCCCACTGGTCCTCAAGA-3'      (SEQ ID NO: 698)
                   5'-CUCCCUCCACUCGGAAGGACUAUCCUG-3'      (SEQ ID NO: 2007)
                   3'-GAGGGAGGUGAGCCUUCCUGAUAGGAC-5'      (SEQ ID NO: 372)
MYC-1531 Target:   5'-CTCCCTCCACTCGGAAGGACTATCCTG-3'      (SEQ ID NO: 699)
                   5'-CACUCGGAAGGACUAUCCUGCUGCCAA-3'      (SEQ ID NO: 2008)
                   3'-GUGAGCCUUCCUGAUAGGACGACGGUU-5'      (SEQ ID NO: 373)
MYC-1538 Target:   5'-CACTCGGAAGGACTATCCTGCTGCCAA-3'      (SEQ ID NO: 700)
```

TABLE 7-continued

Selected Human Anti-MYC "Blunt/Blunt" DsiRNAs

```
              5'-CUAUCCUGCUGCCAAGAGGGUCAAGUU-3'     (SEQ ID NO: 2009)
              3'-GAUAGGACGACGGUUCUCCCAGUUCAA-5'     (SEQ ID NO: 374)
MYC-1550 Target: 5'-CTATCCTGCTGCCAAGAGGGTCAAGTT-3'   (SEQ ID NO: 701)
              5'-CUGCUGCCAAGAGGGUCAAGUUGGACA-3'     (SEQ ID NO: 2010)
              3'-GACGACGGUUCUCCCAGUUCAACCUGU-5'     (SEQ ID NO: 375)
MYC-1555 Target: 5'-CTGCTGCCAAGAGGGTCAAGTTGGACA-3'   (SEQ ID NO: 702)
              5'-GCCAAGAGGGUCAAGUUGGACAGUGUC-3'     (SEQ ID NO: 2011)
              3'-CGGUUCUCCCAGUUCAACCUGUCACAG-5'     (SEQ ID NO: 376)
MYC-1560 Target: 5'-GCCAAGAGGGTCAAGTTGGACAGTGTC-3'   (SEQ ID NO: 703)
              5'-GAGGGUCAAGUUGGACAGUGUCAGAGU-3'     (SEQ ID NO: 2012)
              3'-CUCCCAGUUCAACCUGUCACAGUCUCA-5'     (SEQ ID NO: 377)
MYC-1565 Target: 5'-GAGGGTCAAGTTGGACAGTGTCAGAGT-3'   (SEQ ID NO: 704)
              5'-UCAAGUUGGACAGUGUCAGAGUCCUGA-3'     (SEQ ID NO: 2013)
              3'-AGUUCAACCUGUCACAGUCUCAGGACU-5'     (SEQ ID NO: 378)
MYC-1570 Target: 5'-TCAAGTTGGACAGTGTCAGAGTCCTGA-3'   (SEQ ID NO: 705)
              5'-UUGGACAGUGUCAGAGUCCUGAGACAG-3'     (SEQ ID NO: 2014)
              3'-AACCUGUCACAGUCUCAGGACUCUGUC-5'     (SEQ ID NO: 379)
MYC-1575 Target: 5'-TTGGACAGTGTCAGAGTCCTGAGACAG-3'   (SEQ ID NO: 706)
              5'-GUCAGAGUCCUGAGACAGAUCAGCAAC-3'     (SEQ ID NO: 2015)
              3'-CAGUCUCAGGACUCUGUCUAGUCGUUG-5'     (SEQ ID NO: 380)
MYC-1584 Target: 5'-GTCAGAGTCCTGAGACAGATCAGCAAC-3'   (SEQ ID NO: 707)
              5'-CUGAGACAGAUCAGCAACAACCGAAAA-3'     (SEQ ID NO: 2016)
              3'-GACUCUGUCUAGUCGUUGUUGGCUUUU-5'     (SEQ ID NO: 381)
MYC-1593 Target: 5'-CTGAGACAGATCAGCAACAACCGAAAA-3'   (SEQ ID NO: 708)
              5'-CAGAUCAGCAACAACCGAAAAUGCACC-3'     (SEQ ID NO: 2017)
              3'-GUCUAGUCGUUGUUGGCUUUUACGUGG-5'     (SEQ ID NO: 382)
MYC-1599 Target: 5'-CAGATCAGCAACAACCGAAAATGCACC-3'   (SEQ ID NO: 709)
              5'-GUCCUCGGACACCGAGGAGAAUGUCAA-3'     (SEQ ID NO: 2018)
              3'-CAGGAGCCUGUGGCUCCUCUUACAGUU-5'     (SEQ ID NO: 383)
MYC-1634 Target: 5'-GTCCTCGGACACCGAGGAGAATGTCAA-3'   (SEQ ID NO: 710)
              5'-CGGACACCGAGGAGAAUGUCAAGAGGC-3'     (SEQ ID NO: 2019)
              3'-GCCUGUGGCUCCUCUUACAGUUCUCCG-5'     (SEQ ID NO: 384)
MYC-1639 Target: 5'-CGGACACCGAGGAGAATGTCAAGAGGC-3'   (SEQ ID NO: 711)
              5'-GCCAGAGGAGGAACGAGCUAAAACGGA-3'     (SEQ ID NO: 2020)
              3'-CGGUCUCCUCCUUGCUCGAUUUUGCCU-5'     (SEQ ID NO: 385)
MYC-1687 Target: 5'-GCCAGAGGAGGAACGAGCTAAAACGGA-3'   (SEQ ID NO: 712)
              5'-GGAGGAACGAGCUAAAACGGAGCUUUU-3'     (SEQ ID NO: 2021)
              3'-CCUCCUUGCUCGAUUUUGCCUCGAAAA-5'     (SEQ ID NO: 386)
MYC-1693 Target: 5'-GGAGGAACGAGCTAAAACGGAGCTTTT-3'   (SEQ ID NO: 713)
```

TABLE 7-continued

Selected Human Anti-MYC "Blunt/Blunt" DsiRNAs

```
                     5'-AACGAGCUAAAACGGAGCUUUUUUGCC-3'  (SEQ ID NO: 2022)
                     3'-UUGCUCGAUUUUGCCUCGAAAAAACGG-5'  (SEQ ID NO: 387)
MYC-1698  Target:    5'-AACGAGCTAAAACGGAGCTTTTTTGCC-3'  (SEQ ID NO: 714)

5'-CUAAAACGGAGCUUUUUUGCCCUGCGU-3'  (SEQ ID NO: 2023)
                     3'-GAUUUUGCCUCGAAAAAACGGGACGCA-5'  (SEQ ID NO: 388)
MYC-1704  Target:    5'-CTAAAACGGAGCTTTTTTGCCCTGCGT-3'  (SEQ ID NO: 715)

5'-ACGGAGCUUUUUUGCCCUGCGUGACCA-3'  (SEQ ID NO: 2024)
                     3'-UGCCUCGAAAAAACGGGACGCACUGGU-5'  (SEQ ID NO: 389)
MYC-1709  Target:    5'-ACGGAGCTTTTTTGCCCTGCGTGACCA-3'  (SEQ ID NO: 716)

5'-GUGACCAGAUCCCGGAGUUGGAAAACA-3'  (SEQ ID NO: 2025)
                     3'-CACUGGUCUAGGGCCUCAACCUUUUGU-5'  (SEQ ID NO: 390)
MYC-1729  Target:    5'-GTGACCAGATCCCGGAGTTGGAAAACA-3'  (SEQ ID NO: 717)

5'-CAGAUCCCGGAGUUGGAAAACAAUGAA-3'  (SEQ ID NO: 2026)
                     3'-GUCUAGGGCCUCAACCUUUUGUUACUU-5'  (SEQ ID NO: 391)
MYC-1734  Target:    5'-CAGATCCCGGAGTTGGAAAACAATGAA-3'  (SEQ ID NO: 718)

5'-CCCGGAGUUGGAAAACAAUGAAAAGGC-3'  (SEQ ID NO: 2027)
                     3'-GGGCCUCAACCUUUUGUUACUUUUCCG-5'  (SEQ ID NO: 392)
MYC-1739  Target:    5'-CCCGGAGTTGGAAAACAATGAAAAGGC-3'  (SEQ ID NO: 719)

5'-CAAGGUAGUUAUCCUUAAAAAAGCCAC-3'  (SEQ ID NO: 2028)
                     3'-GUUCCAUCAAUAGGAAUUUUUUCGGUG-5'  (SEQ ID NO: 393)
MYC-1769  Target:    5'-CAAGGTAGTTATCCTTAAAAAAGCCAC-3'  (SEQ ID NO: 720)

5'-UAGUUAUCCUUAAAAAAGCCACAGCAU-3'  (SEQ ID NO: 2029)
                     3'-AUCAAUAGGAAUUUUUUCGGUGUCGUA-5'  (SEQ ID NO: 394)
MYC-1774  Target:    5'-TAGTTATCCTTAAAAAAGCCACAGCAT-3'  (SEQ ID NO: 721)

5'-AUCCUUAAAAAAGCCACAGCAUACAUC-3'  (SEQ ID NO: 2030)
                     3'-UAGGAAUUUUUUCGGUGUCGUAUGUAG-5'  (SEQ ID NO: 395)
MYC-1779  Target:    5'-ATCCTTAAAAAAGCCACAGCATACATC-3'  (SEQ ID NO: 722)

5'-UAAAAAAGCCACAGCAUACAUCCUGUC-3'  (SEQ ID NO: 2031)
                     3'-AUUUUUUCGGUGUCGUAUGUAGGACAG-5'  (SEQ ID NO: 396)
MYC-1784  Target:    5'-TAAAAAAGCCACAGCATACATCCTGTC-3'  (SEQ ID NO: 723)

5'-AAGCCACAGCAUACAUCCUGUCCGUCC-3'  (SEQ ID NO: 2032)
                     3'-UUCGGUGUCGUAUGUAGGACAGGCAGG-5'  (SEQ ID NO: 397)
MYC-1789  Target:    5'-AAGCCACAGCATACATCCTGTCCGTCC-3'  (SEQ ID NO: 724)

5'-CAGCAUACAUCCUGUCCGUCCAAGCAG-3'  (SEQ ID NO: 2033)
                     3'-GUCGUAUGUAGGACAGGCAGGUUCGUC-5'  (SEQ ID NO: 398)
MYC-1795  Target:    5'-CAGCATACATCCTGTCCGTCCAAGCAG-3'  (SEQ ID NO: 725)

5'-AUCCUGUCCGUCCAAGCAGAGGAGCAA-3'  (SEQ ID NO: 2034)
                     3'-UAGGACAGGCAGGUUCGUCUCCUCGUU-5'  (SEQ ID NO: 399)
MYC-1803  Target:    5'-ATCCTGTCCGTCCAAGCAGAGGAGCAA-3'  (SEQ ID NO: 726)
```

TABLE 7-continued

Selected Human Anti-MYC "Blunt/Blunt" DsiRNAs

```
                          5'-GUCCGUCCAAGCAGAGGAGCAAAAGCU-3'  (SEQ ID NO: 2035)
                          3'-CAGGCAGGUUCGUCUCCUCGUUUUCGA-5'  (SEQ ID NO: 400)
MYC-1808  Target: 5'-GTCCGTCCAAGCAGAGGAGCAAAAGCT-3'          (SEQ ID NO: 727)
                          5'-AAGCAGAGGAGCAAAAGCUCAUUUCUG-3'  (SEQ ID NO: 2036)
                          3'-UUCGUCUCCUCGUUUUCGAGUAAAGAC-5'  (SEQ ID NO: 401)
MYC-1816  Target: 5'-AAGCAGAGGAGCAAAAGCTCATTTCTG-3'          (SEQ ID NO: 728)
                          5'-GGAGCAAAAGCUCAUUUCUGAAGAGGA-3'  (SEQ ID NO: 2037)
                          3'-CCUCGUUUUCGAGUAAAGACUUCUCCU-5'  (SEQ ID NO: 402)
MYC-1823  Target: 5'-GGAGCAAAAGCTCATTTCTGAAGAGGA-3'          (SEQ ID NO: 729)
                          5'-AAAAGCUCAUUUCUGAAGAGGACUUGU-3'  (SEQ ID NO: 2038)
                          3'-UUUUCGAGUAAAGACUUCUCCUGAACA-5'  (SEQ ID NO: 403)
MYC-1828  Target: 5'-AAAAGCTCATTTCTGAAGAGGACTTGT-3'          (SEQ ID NO: 730)
                          5'-UCAUUUCUGAAGAGGACUUGUUGCGGA-3'  (SEQ ID NO: 2039)
                          3'-AGUAAAGACUUCUCCUGAACAACGCCU-5'  (SEQ ID NO: 404)
MYC-1834  Target: 5'-TCATTTCTGAAGAGGACTTGTTGCGGA-3'          (SEQ ID NO: 731)
                          5'-CUGAAGAGGACUUGUUGCGGAAACGAC-3'  (SEQ ID NO: 2040)
                          3'-GACUUCUCCUGAACAACGCCUUUGCUG-5'  (SEQ ID NO: 405)
MYC-1840  Target: 5'-CTGAAGAGGACTTGTTGCGGAAACGAC-3'          (SEQ ID NO: 732)
                          5'-GAGGACUUGUUGCGGAAACGACGAGAA-3'  (SEQ ID NO: 2041)
                          3'-CUCCUGAACAACGCCUUUGCUGCUCUU-5'  (SEQ ID NO: 406)
MYC-1845  Target: 5'-GAGGACTTGTTGCGGAAACGACGAGAA-3'          (SEQ ID NO: 733)
                          5'-CUUGUUGCGGAAACGACGAGAACAGUU-3'  (SEQ ID NO: 2042)
                          3'-GAACAACGCCUUUGCUGCUCUUGUCAA-5'  (SEQ ID NO: 407)
MYC-1850  Target: 5'-CTTGTTGCGGAAACGACGAGAACAGTT-3'          (SEQ ID NO: 734)
                          5'-UGCGGAAACGACGAGAACAGUUGAAAC-3'  (SEQ ID NO: 2043)
                          3'-ACGCCUUUGCUGCUCUUGUCAACUUUG-5'  (SEQ ID NO: 408)
MYC-1855  Target: 5'-TGCGGAAACGACGAGAACAGTTGAAAC-3'          (SEQ ID NO: 735)
                          5'-ACAAACUUGAACAGCUACGGAACUCUU-3'  (SEQ ID NO: 2044)
                          3'-UGUUUGAACUUGUCGAUGCCUUGAGAA-5'  (SEQ ID NO: 409)
MYC-1882  Target: 5'-ACAAACTTGAACAGCTACGGAACTCTT-3'          (SEQ ID NO: 736)
                          5'-UUGAACAGCUACGGAACUCUUGUGCGU-3'  (SEQ ID NO: 2045)
                          3'-AACUUGUCGAUGCCUUGAGAACACGCA-5'  (SEQ ID NO: 410)
MYC-1888  Target: 5'-TTGAACAGCTACGGAACTCTTGTGCGT-3'          (SEQ ID NO: 737)
                          5'-CAGCUACGGAACUCUUGUGCGUAAGGA-3'  (SEQ ID NO: 2046)
                          3'-GUCGAUGCCUUGAGAACACGCAUUCCU-5'  (SEQ ID NO: 411)
MYC-1893  Target: 5'-CAGCTACGGAACTCTTGTGCGTAAGGA-3'          (SEQ ID NO: 738)
                          5'-GGAACUCUUGUGCGUAAGGAAAAGUAA-3'  (SEQ ID NO: 2047)
                          3'-CCUUGAGAACACGCAUUCCUUUUCAUU-5'  (SEQ ID NO: 412)
MYC-1900  Target: 5'-GGAACTCTTGTGCGTAAGGAAAAGTAA-3'          (SEQ ID NO: 739)
```

TABLE 7-continued

Selected Human Anti-MYC "Blunt/Blunt" DsiRNAs

```
                5'-CUUGUGCGUAAGGAAAAGUAAGGAAAA-3'    (SEQ ID NO: 2048)
                3'-GAACACGCAUUCCUUUUCAUUCCUUUU-5'    (SEQ ID NO: 413)
MYC-1906 Target: 5'-CTTGTGCGTAAGGAAAAGTAAGGAAAA-3'   (SEQ ID NO: 740)
                5'-GCGUAAGGAAAAGUAAGGAAAACGAUU-3'    (SEQ ID NO: 2049)
                3'-CGCAUUCCUUUUCAUUCCUUUUGCUAA-5'    (SEQ ID NO: 414)
MYC-1911 Target: 5'-GCGTAAGGAAAAGTAAGGAAAACGATT-3'   (SEQ ID NO: 741)
                5'-AAGUAAGGAAAACGAUUCCUUCUAACA-3'    (SEQ ID NO: 2050)
                3'-UUCAUUCCUUUUGCUAAGGAAGAUUGU-5'    (SEQ ID NO: 415)
MYC-1921 Target: 5'-AAGTAAGGAAAACGATTCCTTCTAACA-3'   (SEQ ID NO: 742)
                5'-AGGAAAACGAUUCCUUCUAACAGAAAU-3'    (SEQ ID NO: 2051)
                3'-UCCUUUUGCUAAGGAAGAUUGUCUUUA-5'    (SEQ ID NO: 416)
MYC-1926 Target: 5'-AGGAAAACGATTCCTTCTAACAGAAAT-3'   (SEQ ID NO: 743)
                5'-AACGAUUCCUUCUAACAGAAAUGUCCU-3'    (SEQ ID NO: 2052)
                3'-UUGCUAAGGAAGAUUGUCUUUACAGGA-5'    (SEQ ID NO: 417)
MYC-1931 Target: 5'-AACGATTCCTTCTAACAGAAATGTCCT-3'   (SEQ ID NO: 744)
                5'-UCCUUCUAACAGAAAUGUCCUGAGCAA-3'    (SEQ ID NO: 2053)
                3'-AGGAAGAUUGUCUUUACAGGACUCGUU-5'    (SEQ ID NO: 418)
MYC-1937 Target: 5'-TCCTTCTAACAGAAATGTCCTGAGCAA-3'   (SEQ ID NO: 745)
                5'-AACAGAAAUGUCCUGAGCAAUCACCUA-3'    (SEQ ID NO: 2054)
                3'-UUGUCUUUACAGGACUCGUUAGUGGAU-5'    (SEQ ID NO: 419)
MYC-1944 Target: 5'-AACAGAAATGTCCTGAGCAATCACCTA-3'   (SEQ ID NO: 746)
                5'-GUCCUGAGCAAUCACCUAUGAACUUGU-3'    (SEQ ID NO: 2055)
                3'-CAGGACUCGUUAGUGGAUACUUGAACA-5'    (SEQ ID NO: 420)
MYC-1953 Target: 5'-GTCCTGAGCAATCACCTATGAACTTGT-3'   (SEQ ID NO: 747)
                5'-AGCAAUCACCUAUGAACUUGUUUCAAA-3'    (SEQ ID NO: 2056)
                3'-UCGUUAGUGGAUACUUGAACAAAGUUU-5'    (SEQ ID NO: 421)
MYC-1959 Target: 5'-AGCAATCACCTATGAACTTGTTTCAAA-3'   (SEQ ID NO: 748)
                5'-CACCUAUGAACUUGUUUCAAAUGCAUG-3'    (SEQ ID NO: 2057)
                3'-GUGGAUACUUGAACAAAGUUUACGUAC-5'    (SEQ ID NO: 422)
MYC-1965 Target: 5'-CACCTATGAACTTGTTTCAAATGCATG-3'   (SEQ ID NO: 749)
                5'-AUGAACUUGUUUCAAAUGCAUGAUCAA-3'    (SEQ ID NO: 2058)
                3'-UACUUGAACAAAGUUUACGUACUAGUU-5'    (SEQ ID NO: 423)
MYC-1970 Target: 5'-ATGAACTTGTTTCAAATGCATGATCAA-3'   (SEQ ID NO: 750)
                5'-UUGUUUCAAAUGCAUGAUCAAAUGCAA-3'    (SEQ ID NO: 2059)
                3'-AACAAAGUUUACGUACUAGUUUACGUU-5'    (SEQ ID NO: 424)
MYC-1976 Target: 5'-TTGTTTCAAATGCATGATCAAATGCAA-3'   (SEQ ID NO: 751)
                5'-UCAAAUGCAUGAUCAAAUGCAACCUCA-3'    (SEQ ID NO: 2060)
                3'-AGUUUACGUACUAGUUUACGUUGGAGU-5'    (SEQ ID NO: 425)
MYC-1981 Target: 5'-TCAAATGCATGATCAAATGCAACCTCA-3'   (SEQ ID NO: 752)
```

TABLE 7-continued

Selected Human Anti-MYC "Blunt/Blunt" DsiRNAs

```
              5'-AUGAUCAAAUGCAACCUCACAACCUUG-3'  (SEQ ID NO: 2061)
              3'-UACUAGUUUACGUUGGAGUGUUGGAAC-5'  (SEQ ID NO: 426)
MYC-1989 Target: 5'-ATGATCAAATGCAACCTCACAACCTTG-3'  (SEQ ID NO: 753)
              5'-CAAAUGCAACCUCACAACCUUGGCUGA-3'  (SEQ ID NO: 2062)
              3'-GUUUACGUUGGAGUGUUGGAACCGACU-5'  (SEQ ID NO: 427)
MYC-1994 Target: 5'-CAAATGCAACCTCACAACCTTGGCTGA-3'  (SEQ ID NO: 754)
              5'-AACCUCACAACCUUGGCUGAGUCUUGA-3'  (SEQ ID NO: 2063)
              3'-UUGGAGUGUUGGAACCGACUCAGAACU-5'  (SEQ ID NO: 428)
MYC-2001 Target: 5'-AACCTCACAACCTTGGCTGAGTCTTGA-3'  (SEQ ID NO: 755)
              5'-CACAACCUUGGCUGAGUCUUGAGACUG-3'  (SEQ ID NO: 2064)
              3'-GUGUUGGAACCGACUCAGAACUCUGAC-5'  (SEQ ID NO: 429)
MYC-2006 Target: 5'-CACAACCTTGGCTGAGTCTTGAGACTG-3'  (SEQ ID NO: 756)
              5'-UUGGCUGAGUCUUGAGACUGAAAGAUU-3'  (SEQ ID NO: 2065)
              3'-AACCGACUCAGAACUCUGACUUUCUAA-5'  (SEQ ID NO: 430)
MYC-2013 Target: 5'-TTGGCTGAGTCTTGAGACTGAAAGATT-3'  (SEQ ID NO: 757)
              5'-GAGUCUUGAGACUGAAAGAUUUAGCCA-3'  (SEQ ID NO: 2066)
              3'-CUCAGAACUCUGACUUUCUAAAUCGGU-5'  (SEQ ID NO: 431)
MYC-2019 Target: 5'-GAGTCTTGAGACTGAAAGATTTAGCCA-3'  (SEQ ID NO: 758)
              5'-GAGACUGAAAGAUUUAGCCAUAAUGUA-3'  (SEQ ID NO: 2067)
              3'-CUCUGACUUUCUAAAUCGGUAUUACAU-5'  (SEQ ID NO: 432)
MYC-2026 Target: 5'-GAGACTGAAAGATTTAGCCATAATGTA-3'  (SEQ ID NO: 759)
              5'-UGAAAGAUUUAGCCAUAAUGUAAACUG-3'  (SEQ ID NO: 2068)
              3'-ACUUUCUAAAUCGGUAUUACAUUUGAC-5'  (SEQ ID NO: 433)
MYC-2031 Target: 5'-TGAAAGATTTAGCCATAATGTAAACTG-3'  (SEQ ID NO: 760)
              5'-UAGCCAUAAUGUAAACUGCCUCAAAUU-3'  (SEQ ID NO: 2069)
              3'-AUCGGUAUUACAUUUGACGGAGUUUAA-5'  (SEQ ID NO: 434)
MYC-2040 Target: 5'-TAGCCATAATGTAAACTGCCTCAAATT-3'  (SEQ ID NO: 761)
              5'-AUGUAAACUGCCUCAAAUUGGACUUUG-3'  (SEQ ID NO: 2070)
              3'-UACAUUUGACGGAGUUUAACCUGAAAC-5'  (SEQ ID NO: 435)
MYC-2048 Target: 5'-ATGTAAACTGCCTCAAATTGGACTTTG-3'  (SEQ ID NO: 762)
              5'-ACUGCCUCAAAUUGGACUUUGGGCAUA-3'  (SEQ ID NO: 2071)
              3'-UGACGGAGUUUAACCUGAAACCCGUAU-5'  (SEQ ID NO: 436)
MYC-2054 Target: 5'-ACTGCCTCAAATTGGACTTTGGGCATA-3'  (SEQ ID NO: 763)
              5'-CUCAAAUUGGACUUUGGGCAUAAAAGA-3'  (SEQ ID NO: 2072)
              3'-GAGUUUAACCUGAAACCCGUAUUUUCU-5'  (SEQ ID NO: 437)
MYC-2059 Target: 5'-CTCAAATTGGACTTTGGGCATAAAAGA-3'  (SEQ ID NO: 764)
              5'-UGGACUUUGGGCAUAAAAGAACUUUUU-3'  (SEQ ID NO: 2073)
              3'-ACCUGAAACCCGUAUUUUCUUGAAAAA-5'  (SEQ ID NO: 438)
MYC-2066 Target: 5'-TGGACTTTGGGCATAAAAGAACTTTTT-3'  (SEQ ID NO: 765)
```

TABLE 7-continued

Selected Human Anti-MYC "Blunt/Blunt" DsiRNAs

```
                     5'-UGGGCAUAAAAGAACUUUUUUAUGCUU-3'   (SEQ ID NO: 2074)
                     3'-ACCCGUAUUUUCUUGAAAAAAUACGAA-5'   (SEQ ID NO: 439)
MYC-2073 Target:     5'-TGGGCATAAAAGAACTTTTTTATGCTT-3'   (SEQ ID NO: 766)
                     5'-AUAAAAGAACUUUUUUAUGCUUACCAU-3'   (SEQ ID NO: 2075)
                     3'-UAUUUUCUUGAAAAAAUACGAAUGGUA-5'   (SEQ ID NO: 440)
MYC-2078 Target:     5'-ATAAAAGAACTTTTTTATGCTTACCAT-3'   (SEQ ID NO: 767)
                     5'-AGAACUUUUUUAUGCUUACCAUCUUUU-3'   (SEQ ID NO: 2076)
                     3'-UCUUGAAAAAAUACGAAUGGUAGAAAA-5'   (SEQ ID NO: 441)
MYC-2083 Target:     5'-AGAACTTTTTTATGCTTACCATCTTTT-3'   (SEQ ID NO: 768)
                     5'-UUUUUAUGCUUACCAUCUUUUUUUUU-3'    (SEQ ID NO: 2077)
                     3'-AAAAAUACGAAUGGUAGAAAAAAAAA-5'    (SEQ ID NO: 442)
MYC-2089 Target:     5'-TTTTTATGCTTACCATCTTTTTTTTT-3'    (SEQ ID NO: 769)
                     5'-AUGCUUACCAUCUUUUUUUUUCUUUA-3'    (SEQ ID NO: 2078)
                     3'-UACGAAUGGUAGAAAAAAAAAGAAAU-5'    (SEQ ID NO: 443)
MYC-2094 Target:     5'-ATGCTTACCATCTTTTTTTTTCTTTA-3'    (SEQ ID NO: 770)
                     5'-UACCAUCUUUUUUUUUCUUUAACAGA-3'    (SEQ ID NO: 2079)
                     3'-AUGGUAGAAAAAAAAAGAAAUUGUCU-5'    (SEQ ID NO: 444)
MYC-2099 Target:     5'-TACCATCTTTTTTTTTCTTTAACAGA-3'    (SEQ ID NO: 771)
                     5'-CUUUUUUUUUCUUUAACAGAUUUGUA-3'    (SEQ ID NO: 2080)
                     3'-GAAAAAAAAAGAAAUUGUCUAAACAU-5'    (SEQ ID NO: 445)
MYC-2105 Target:     5'-CTTTTTTTTTCTTTAACAGATTTGTA-3'    (SEQ ID NO: 772)
                     5'-UUCUUUAACAGAUUUGUAUUUAAGAAU-3'   (SEQ ID NO: 2081)
                     3'-AAGAAAUUGUCUAAACAUAAAUUCUUA-5'   (SEQ ID NO: 446)
MYC-2114 Target:     5'-TTCTTTAACAGATTTGTATTTAAGAAT-3'   (SEQ ID NO: 773)
                     5'-AACAGAUUUGUAUUUAAGAAUUGUUUU-3'   (SEQ ID NO: 2082)
                     3'-UUGUCUAAACAUAAAUUCUUAACAAAA-5'   (SEQ ID NO: 447)
MYC-2120 Target:     5'-AACAGATTTGTATTTAAGAATTGTTTT-3'   (SEQ ID NO: 774)
                     5'-UGUAUUUAAGAAUUGUUUUAAAAAAU-3'    (SEQ ID NO: 2083)
                     3'-ACAUAAAUUCUUAACAAAAUUUUUUA-5'    (SEQ ID NO: 448)
MYC-2128 Target:     5'-TGTATTTAAGAATTGTTTTAAAAAAT-3'    (SEQ ID NO: 775)
                     5'-AAGAAUUGUUUUUAAAAAAUUUUAAGA-3'   (SEQ ID NO: 2084)
                     3'-UUCUUAACAAAAUUUUUUAAAAUUCU-5'    (SEQ ID NO: 449)
MYC-2135 Target:     5'-AAGAATTGTTTTAAAAAATTTTAAGA-3'    (SEQ ID NO: 776)
                     5'-ACAAUGUUUCUCUGUAAAUAUUGCCAU-3'   (SEQ ID NO: 2085)
                     3'-UGUUACAAAGAGACAUUUAUAACGGUA-5'   (SEQ ID NO: 450)
MYC-2167 Target:     5'-ACAATGTTTCTCTGTAAATATTGCCAT-3'   (SEQ ID NO: 777)
                     5'-CUCUGUAAAUAUUGCCAUUAAAUGUAA-3'   (SEQ ID NO: 2086)
                     3'-GAGACAUUUAUAACGGUAAUUUACAUU-5'   (SEQ ID NO: 451)
MYC-2176 Target:     5'-CTCTGTAAATATTGCCATTAAATGTAA-3'   (SEQ ID NO: 778)
```

TABLE 7-continued

Selected Human Anti-MYC "Blunt/Blunt" DsiRNAs

|  |  |  |
|---|---|---|
|  | 5'-UAAAUAUUGCCAUUAAAUGUAAAUAAC-3' | (SEQ ID NO: 2087) |
|  | 3'-AUUUAUAACGGUAAUUUACAUUUAUUG-5' | (SEQ ID NO: 452) |
| MYC-2181 Target: | 5'-TAAATATTGCCATTAAATGTAAATAAC-3' | (SEQ ID NO: 779) |
|  | 5'-UGCCAUUAAAUGUAAAUAACUUUAAUA-3' | (SEQ ID NO: 2088) |
|  | 3'-ACGGUAAUUUACAUUUAUUGAAAUUAU-5' | (SEQ ID NO: 453) |
| MYC-2188 Target: | 5'-TGCCATTAAATGTAAATAACTTTAATA-3' | (SEQ ID NO: 780) |
|  | 5'-CUUUAAUAAAACGUUUAUAGCAGUUAC-3' | (SEQ ID NO: 2089) |
|  | 3'-GAAAUUAUUUUGCAAAUAUCGUCAAUG-5' | (SEQ ID NO: 454) |
| MYC-2207 Target: | 5'-CTTTAATAAAACGTTTATAGCAGTTAC-3' | (SEQ ID NO: 781) |
|  | 5'-CACAGAAUUUCAAUCCUAGUAUAUAGU-3' | (SEQ ID NO: 2090) |
|  | 3'-GUGUCUUAAAGUUAGGAUCAUAUAUCA-5' | (SEQ ID NO: 455) |
| MYC-2233 Target: | 5'-CACAGAATTTCAATCCTAGTATATAGT-3' | (SEQ ID NO: 782) |
|  | 5'-ACCUAGUAUUAUAGGUACUAUAAACCC-3' | (SEQ ID NO: 2091) |
|  | 3'-UGGAUCAUAAUAUCCAUGAUAUUUGGG-5' | (SEQ ID NO: 456) |
| MYC-2260 Target: | 5'-ACCTAGTATTATAGGTACTATAAACCC-3' | (SEQ ID NO: 783) |
|  | 5'-AUUAUAGGUACUAUAAACCCUAAUUUU-3' | (SEQ ID NO: 2092) |
|  | 3'-UAAUAUCCAUGAUAUUUGGGAUUAAAA-5' | (SEQ ID NO: 457) |
| MYC-2267 Target: | 5'-ATTATAGGTACTATAAACCCTAATTTT-3' | (SEQ ID NO: 784) |
|  | 5'-GUACUAUAAACCCUAAUUUUUUUAUU-3' | (SEQ ID NO: 2093) |
|  | 3'-CAUGAUAUUUGGGAUUAAAAAAAAUAA-5' | (SEQ ID NO: 458) |
| MYC-2274 Target: | 5'-GTACTATAAACCCTAATTTTTTTATT-3' | (SEQ ID NO: 785) |
|  | 5'-AACCCUAAUUUUUUUAUUUAAGUACA-3' | (SEQ ID NO: 2094) |
|  | 3'-UUGGGAUUAAAAAAAAUAAAUUCAUGU-5' | (SEQ ID NO: 459) |
| MYC-2282 Target: | 5'-AACCCTAATTTTTTTATTTAAGTACA-3' | (SEQ ID NO: 786) |
|  | 5'-UAAUUUUUUUAUUUAAGUACAUUUUG-3' | (SEQ ID NO: 2095) |
|  | 3'-AUUAAAAAAAAUAAAUUCAUGUAAAAC-5' | (SEQ ID NO: 460) |
| MYC-2287 Target: | 5'-TAATTTTTTTATTTAAGTACATTTTG-3' | (SEQ ID NO: 787) |
|  | 5'-UUUAUUUAAGUACAUUUUGCUUUUUAA-3' | (SEQ ID NO: 2096) |
|  | 3'-AAAUAAAUUCAUGUAAAACGAAAAAUU-5' | (SEQ ID NO: 461) |
| MYC-2295 Target: | 5'-TTTATTTAAGTACATTTTGCTTTTTAA-3' | (SEQ ID NO: 788) |
|  | 5'-UUAAGUACAUUUUGCUUUUUAAAGUUG-3' | (SEQ ID NO: 2097) |
|  | 3'-AAUUCAUGUAAAACGAAAAAUUUCAAC-5' | (SEQ ID NO: 462) |
| MYC-2300 Target: | 5'-TTAAGTACATTTTGCTTTTTAAAGTTG-3' | (SEQ ID NO: 789) |
|  | 5'-ACAUUUUGCUUUUUAAAGUUGAUUUUU-3' | (SEQ ID NO: 2098) |
|  | 3'-UGUAAAACGAAAAAUUUCAACUAAAAA-5' | (SEQ ID NO: 463) |
| MYC-2306 Target: | 5'-ACATTTTGCTTTTTAAAGTTGATTTTT-3' | (SEQ ID NO: 790) |
|  | 5'-UGCUUUUUAAAGUUGAUUUUUUCUAU-3' | (SEQ ID NO: 2099) |
|  | 3'-ACGAAAAAUUUCAACUAAAAAAGAUA-5' | (SEQ ID NO: 464) |
| MYC-2312 Target: | 5'-TGCTTTTTAAAGTTGATTTTTTCTAT-3' | (SEQ ID NO: 791) |

TABLE 7-continued

Selected Human Anti-MYC "Blunt/Blunt" DsiRNAs

```
                5'-UCUAUUGUUUUUAGAAAAAAUAAAAUA-3'   (SEQ ID NO: 2100)
                3'-AGAUAACAAAAAUCUUUUUUAUUUUAU-5'   (SEQ ID NO: 465)
MYC-2334 Target: 5'-TCTATTGTTTTTAGAAAAAATAAAATA-3'   (SEQ ID NO: 792)
                5'-UGUUUUUAGAAAAAAUAAAAUAACUGG-3'   (SEQ ID NO: 2101)
                3'-ACAAAAAUCUUUUUUAUUUUAUUGACC-5'   (SEQ ID NO: 466)
MYC-2339 Target: 5'-TGTTTTTAGAAAAAATAAAATAACTGG-3'   (SEQ ID NO: 793)
                5'-GAAAAAAUAAAAUAACUGGCAAAUAUA-3'   (SEQ ID NO: 2102)
                3'-CUUUUUUAUUUUAUUGACCGUUUAUAU-5'   (SEQ ID NO: 467)
MYC-2347 Target: 5'-GAAAAATAAAATAACTGGCAAATATA-3'   (SEQ ID NO: 794)
                5'-AAAAUAACUGGCAAAUAUAUCAUUGAG-3'   (SEQ ID NO: 2103)
                3'-UUUUAUUGACCGUUUAUAUAGUAACUC-5'   (SEQ ID NO: 468)
MYC-2355 Target: 5'-AAAATAACTGGCAAATATATCATTGAG-3'   (SEQ ID NO: 795)
                5'-GGCAAAUAUAUCAUUGAGCCAAAUCUU-3'   (SEQ ID NO: 2104)
                3'-CCGUUUAUAUAGUAACUCGGUUUAGAA-5'   (SEQ ID NO: 469)
MYC-2364 Target: 5'-GGCAAATATATCATTGAGCCAAATCTT-3'   (SEQ ID NO: 796)
                5'-AUAUCAUUGAGCCAAAUCUUAAAAAAA-3'   (SEQ ID NO: 2105)
                3'-UAUAGUAACUCGGUUUAGAAUUUUUUU-5'   (SEQ ID NO: 470)
MYC-2371 Target: 5'-ATATCATTGAGCCAAATCTTAAAAAAA-3'   (SEQ ID NO: 797)
                5'-UUGAGCCAAAUCUUAAAAAAAAAAAAA-3'   (SEQ ID NO: 2106)
                3'-AACUCGGUUUAGAAUUUUUUUUUUUUU-5'   (SEQ ID NO: 471)
MYC-2377 Target: 5'-TTGAGCCAAATCTTAAAAAAAAAAAAA-3'   (SEQ ID NO: 798)
                5'-UAACUCGCUGUAGUAAUUCCAGCGAGA-3'   (SEQ ID NO: 2107)
                3'-AUUGAGCGACAUCAUUAAGGUCGCUCU-5'   (SEQ ID NO: 472)
MYC-188 Target:  5'-TAACTCGCTGTAGTAATTCCAGCGAGA-3'   (SEQ ID NO: 799)
                5'-AACUCGCUGUAGUAAUUCCAGCGAGAG-3'   (SEQ ID NO: 2108)
                3'-UUGAGCGACAUCAUUAAGGUCGCUCUC-5'   (SEQ ID NO: 473)
MYC-189 Target:  5'-AACTCGCTGTAGTAATTCCAGCGAGAG-3'   (SEQ ID NO: 800)
                5'-ACUCGCUGUAGUAAUUCCAGCGAGAGG-3'   (SEQ ID NO: 2109)
                3'-UGAGCGACAUCAUUAAGGUCGCUCUCC-5'   (SEQ ID NO: 474)
MYC-190 Target:  5'-ACTCGCTGTAGTAATTCCAGCGAGAGG-3'   (SEQ ID NO: 801)
                5'-CUCGCUGUAGUAAUUCCAGCGAGAGGC-3'   (SEQ ID NO: 2110)
                3'-GAGCGACAUCAUUAAGGUCGCUCUCCG-5'   (SEQ ID NO: 475)
MYC-191 Target:  5'-CTCGCTGTAGTAATTCCAGCGAGAGGC-3'   (SEQ ID NO: 802)
                5'-UCGCUGUAGUAAUUCCAGCGAGAGGCA-3'   (SEQ ID NO: 2111)
                3'-AGCGACAUCAUUAAGGUCGCUCUCCGU-5'   (SEQ ID NO: 476)
MYC-192 Target:  5'-TCGCTGTAGTAATTCCAGCGAGAGGCA-3'   (SEQ ID NO: 803)
                5'-CGCUGUAGUAAUUCCAGCGAGAGGCAG-3'   (SEQ ID NO: 2112)
                3'-GCGACAUCAUUAAGGUCGCUCUCCGUC-5'   (SEQ ID NO: 477)
MYC-193 Target:  5'-CGCTGTAGTAATTCCAGCGAGAGGCAG-3'   (SEQ ID NO: 804)
```

TABLE 7-continued

Selected Human Anti-MYC "Blunt/Blunt" DsiRNAs

```
               5'-GCUGUAGUAAUUCCAGCGAGAGGCAGA-3'  (SEQ ID NO: 2113)
               3'-CGACAUCAUUAAGGUCGCUCUCCGUCU-5'  (SEQ ID NO: 478)
MYC-194 Target: 5'-GCTGTAGTAATTCCAGCGAGAGGCAGA-3'  (SEQ ID NO: 805)
               5'-CUGUAGUAAUUCCAGCGAGAGGCAGAG-3'  (SEQ ID NO: 2114)
               3'-GACAUCAUUAAGGUCGCUCUCCGUCUC-5'  (SEQ ID NO: 479)
MYC-195 Target: 5'-CTGTAGTAATTCCAGCGAGAGGCAGAG-3'  (SEQ ID NO: 806)
               5'-AGCUUCACCAACAGGAACUAUGACCUC-3'  (SEQ ID NO: 2115)
               3'-UCGAAGUGGUUGUCCUUGAUACUGGAG-5'  (SEQ ID NO: 480)
MYC-612 Target: 5'-AGCTTCACCAACAGGAACTATGACCTC-3'  (SEQ ID NO: 807)
               5'-GCUUCACCAACAGGAACUAUGACCUCG-3'  (SEQ ID NO: 2116)
               3'-CGAAGUGGUUGUCCUUGAUACUGGAGC-5'  (SEQ ID NO: 481)
MYC-613 Target: 5'-GCTTCACCAACAGGAACTATGACCTCG-3'  (SEQ ID NO: 808)
               5'-CUUCACCAACAGGAACUAUGACCUCGA-3'  (SEQ ID NO: 2117)
               3'-GAAGUGGUUGUCCUUGAUACUGGAGCU-5'  (SEQ ID NO: 482)
MYC-614 Target: 5'-CTTCACCAACAGGAACTATGACCTCGA-3'  (SEQ ID NO: 809)
               5'-UUCACCAACAGGAACUAUGACCUCGAC-3'  (SEQ ID NO: 2118)
               3'-AAGUGGUUGUCCUUGAUACUGGAGCUG-5'  (SEQ ID NO: 483)
MYC-615 Target: 5'-TTCACCAACAGGAACTATGACCTCGAC-3'  (SEQ ID NO: 810)
               5'-UCACCAACAGGAACUAUGACCUCGACU-3'  (SEQ ID NO: 2119)
               3'-AGUGGUUGUCCUUGAUACUGGAGCUGA-5'  (SEQ ID NO: 484)
MYC-616 Target: 5'-TCACCAACAGGAACTATGACCTCGACT-3'  (SEQ ID NO: 811)
               5'-CACCAACAGGAACUAUGACCUCGACUA-3'  (SEQ ID NO: 2120)
               3'-GUGGUUGUCCUUGAUACUGGAGCUGAU-5'  (SEQ ID NO: 485)
MYC-617 Target: 5'-CACCAACAGGAACTATGACCTCGACTA-3'  (SEQ ID NO: 812)
               5'-ACCAACAGGAACUAUGACCUCGACUAC-3'  (SEQ ID NO: 2121)
               3'-UGGUUGUCCUUGAUACUGGAGCUGAUG-5'  (SEQ ID NO: 486)
MYC-618 Target: 5'-ACCAACAGGAACTATGACCTCGACTAC-3'  (SEQ ID NO: 813)
               5'-CCAACAGGAACUAUGACCUCGACUACG-3'  (SEQ ID NO: 2122)
               3'-GGUUGUCCUUGAUACUGGAGCUGAUGC-5'  (SEQ ID NO: 487)
MYC-619 Target: 5'-CCAACAGGAACTATGACCTCGACTACG-3'  (SEQ ID NO: 814)
               5'-CAACAGGAACUAUGACCUCGACUACGA-3'  (SEQ ID NO: 2123)
               3'-GUUGUCCUUGAUACUGGAGCUGAUGCU-5'  (SEQ ID NO: 488)
MYC-620 Target: 5'-CAACAGGAACTATGACCTCGACTACGA-3'  (SEQ ID NO: 815)
               5'-AACAGGAACUAUGACCUCGACUACGAC-3'  (SEQ ID NO: 2124)
               3'-UUGUCCUUGAUACUGGAGCUGAUGCUG-5'  (SEQ ID NO: 489)
MYC-621 Target: 5'-AACAGGAACTATGACCTCGACTACGAC-3'  (SEQ ID NO: 816)
               5'-ACAGGAACUAUGACCUCGACUACGACU-3'  (SEQ ID NO: 2125)
               3'-UGUCCUUGAUACUGGAGCUGAUGCUGA-5'  (SEQ ID NO: 490)
MYC-622 Target: 5'-ACAGGAACTATGACCTCGACTACGACT-3'  (SEQ ID NO: 817)
```

TABLE 7-continued

Selected Human Anti-MYC "Blunt/Blunt" DsiRNAs

```
              5'-CAGGAACUAUGACCUCGACUACGACUC-3'   (SEQ ID NO: 2126)
              3'-GUCCUUGAUACUGGAGCUGAUGCUGAG-5'   (SEQ ID NO: 491)
MYC-623 Target: 5'-CAGGAACTATGACCTCGACTACGACTC-3'  (SEQ ID NO: 818)
              5'-AGGAACUAUGACCUCGACUACGACUCG-3'   (SEQ ID NO: 2127)
              3'-UCCUUGAUACUGGAGCUGAUGCUGAGC-5'   (SEQ ID NO: 492)
MYC-624 Target: 5'-AGGAACTATGACCTCGACTACGACTCG-3'  (SEQ ID NO: 819)
              5'-GGAACUAUGACCUCGACUACGACUCGG-3'   (SEQ ID NO: 2128)
              3'-CCUUGAUACUGGAGCUGAUGCUGAGCC-5'   (SEQ ID NO: 493)
MYC-625 Target: 5'-GGAACTATGACCTCGACTACGACTCGG-3'  (SEQ ID NO: 820)
              5'-GAACUAUGACCUCGACUACGACUCGGU-3'   (SEQ ID NO: 2129)
              3'-CUUGAUACUGGAGCUGAUGCUGAGCCA-5'   (SEQ ID NO: 494)
MYC-626 Target: 5'-GAACTATGACCTCGACTACGACTCGGT-3'  (SEQ ID NO: 821)
              5'-AACUAUGACCUCGACUACGACUCGGUG-3'   (SEQ ID NO: 2130)
              3'-UUGAUACUGGAGCUGAUGCUGAGCCAC-5'   (SEQ ID NO: 495)
MYC-627 Target: 5'-AACTATGACCTCGACTACGACTCGGTG-3'  (SEQ ID NO: 822)
              5'-ACUAUGACCUCGACUACGACUCGGUGC-3'   (SEQ ID NO: 2131)
              3'-UGAUACUGGAGCUGAUGCUGAGCCACG-5'   (SEQ ID NO: 496)
MYC-628 Target: 5'-ACTATGACCTCGACTACGACTCGGTGC-3'  (SEQ ID NO: 823)
              5'-CUAUGACCUCGACUACGACUCGGUGCA-3'   (SEQ ID NO: 2132)
              3'-GAUACUGGAGCUGAUGCUGAGCCACGU-5'   (SEQ ID NO: 497)
MYC-629 Target: 5'-CTATGACCTCGACTACGACTCGGTGCA-3'  (SEQ ID NO: 824)
              5'-GCGAGGAUAUCUGGAAGAAAUUCGAGC-3'   (SEQ ID NO: 2133)
              3'-CGCUCCUAUAGACCUUCUUUAAGCUCG-5'   (SEQ ID NO: 498)
MYC-733 Target: 5'-GCGAGGATATCTGGAAGAAATTCGAGC-3'  (SEQ ID NO: 825)
              5'-CGAGGAUAUCUGGAAGAAAUUCGAGCU-3'   (SEQ ID NO: 2134)
              3'-GCUCCUAUAGACCUUCUUUAAGCUCGA-5'   (SEQ ID NO: 499)
MYC-734 Target: 5'-CGAGGATATCTGGAAGAAATTCGAGCT-3'  (SEQ ID NO: 826)
              5'-GAGGAUAUCUGGAAGAAAUUCGAGCUG-3'   (SEQ ID NO: 2135)
              3'-CUCCUAUAGACCUUCUUUAAGCUCGAC-5'   (SEQ ID NO: 500)
MYC-735 Target: 5'-GAGGATATCTGGAAGAAATTCGAGCTG-3'  (SEQ ID NO: 827)
              5'-AGGAUAUCUGGAAGAAAUUCGAGCUGC-3'   (SEQ ID NO: 2136)
              3'-UCCUAUAGACCUUCUUUAAGCUCGACG-5'   (SEQ ID NO: 501)
MYC-736 Target: 5'-AGGATATCTGGAAGAAATTCGAGCTGC-3'  (SEQ ID NO: 828)
              5'-GGAUAUCUGGAAGAAAUUCGAGCUGCU-3'   (SEQ ID NO: 2137)
              3'-CCUAUAGACCUUCUUUAAGCUCGACGA-5'   (SEQ ID NO: 502)
MYC-737 Target: 5'-GGATATCTGGAAGAAATTCGAGCTGCT-3'  (SEQ ID NO: 829)
              5'-GAUAUCUGGAAGAAAUUCGAGCUGCUG-3'   (SEQ ID NO: 2138)
              3'-CUAUAGACCUUCUUUAAGCUCGACGAC-5'   (SEQ ID NO: 503)
MYC-738 Target: 5'-GATATCTGGAAGAAATTCGAGCTGCTG-3'  (SEQ ID NO: 830)
```

TABLE 7-continued

Selected Human Anti-MYC "Blunt/Blunt" DsiRNAs

```
                        5'-AUAUCUGGAAGAAAUUCGAGCUGCUGC-3'    (SEQ ID NO: 2139)
                        3'-UAUAGACCUUCUUUAAGCUCGACGACG-5'    (SEQ ID NO: 504)
MYC-739 Target:         5'-ATATCTGGAAGAAATTCGAGCTGCTGC-3'    (SEQ ID NO: 831)

5'-UAUCUGGAAGAAAUUCGAGCUGCUGCC-3'    (SEQ ID NO: 2140)
                        3'-AUAGACCUUCUUUAAGCUCGACGACGG-5'    (SEQ ID NO: 505)
MYC-740 Target:         5'-TATCTGGAAGAAATTCGAGCTGCTGCC-3'    (SEQ ID NO: 832)

5'-AUCUGGAAGAAAUUCGAGCUGCUGCCC-3'    (SEQ ID NO: 2141)
                        3'-UAGACCUUCUUUAAGCUCGACGACGGG-5'    (SEQ ID NO: 506)
MYC-741 Target:         5'-ATCTGGAAGAAATTCGAGCTGCTGCCC-3'    (SEQ ID NO: 833)

5'-UCUGGAAGAAAUUCGAGCUGCUGCCCA-3'    (SEQ ID NO: 2142)
                        3'-AGACCUUCUUUAAGCUCGACGACGGGU-5'    (SEQ ID NO: 507)
MYC-742 Target:         5'-TCTGGAAGAAATTCGAGCTGCTGCCCA-3'    (SEQ ID NO: 834)

5'-CUGGAAGAAAUUCGAGCUGCUGCCCAC-3'    (SEQ ID NO: 2143)
                        3'-GACCUUCUUUAAGCUCGACGACGGGUG-5'    (SEQ ID NO: 508)
MYC-743 Target:         5'-CTGGAAGAAATTCGAGCTGCTGCCCAC-3'    (SEQ ID NO: 835)

5'-CUAGCCGCCGCUCCGGGCUCUGCUCGC-3'    (SEQ ID NO: 2144)
                        3'-GAUCGGCGGCGAGGCCCGAGACGAGCG-5'    (SEQ ID NO: 509)
MYC-784 Target:         5'-CTAGCCGCCGCTCCGGGCTCTGCTCGC-3'    (SEQ ID NO: 836)

5'-UAGCCGCCGCUCCGGGCUCUGCUCGCC-3'    (SEQ ID NO: 2145)
                        3'-AUCGGCGGCGAGGCCCGAGACGAGCGG-5'    (SEQ ID NO: 510)
MYC-785 Target:         5'-TAGCCGCCGCTCCGGGCTCTGCTCGCC-3'    (SEQ ID NO: 837)

5'-AGCCGCCGCUCCGGGCUCUGCUCGCCC-3'    (SEQ ID NO: 2146)
                        3'-UCGGCGGCGAGGCCCGAGACGAGCGGG-5'    (SEQ ID NO: 511)
MYC-786 Target:         5'-AGCCGCCGCTCCGGGCTCTGCTCGCCC-3'    (SEQ ID NO: 838)

5'-GCCGCCGCUCCGGGCUCUGCUCGCCCU-3'    (SEQ ID NO: 2147)
                        3'-CGGCGGCGAGGCCCGAGACGAGCGGGA-5'    (SEQ ID NO: 512)
MYC-787 Target:         5'-GCCGCCGCTCCGGGCTCTGCTCGCCCT-3'    (SEQ ID NO: 839)

5'-CCGCCGCUCCGGGCUCUGCUCGCCCUC-3'    (SEQ ID NO: 2148)
                        3'-GGCGGCGAGGCCCGAGACGAGCGGGAG-5'    (SEQ ID NO: 513)
MYC-788 Target:         5'-CCGCCGCTCCGGGCTCTGCTCGCCCTC-3'    (SEQ ID NO: 840)

5'-UGGGAGGAGACAUGGUGAACCAGAGUU-3'    (SEQ ID NO: 2149)
                        3'-ACCCUCCUCUGUACCACUUGGUCUCAA-5'    (SEQ ID NO: 514)
MYC-913 Target:         5'-TGGGAGGAGACATGGTGAACCAGAGTT-3'    (SEQ ID NO: 841)

5'-GGGAGGAGACAUGGUGAACCAGAGUUU-3'    (SEQ ID NO: 2150)
                        3'-CCCUCCUCUGUACCACUUGGUCUCAAA-5'    (SEQ ID NO: 515)
MYC-914 Target:         5'-GGGAGGAGACATGGTGAACCAGAGTTT-3'    (SEQ ID NO: 842)

5'-GGAGGAGACAUGGUGAACCAGAGUUUC-3'    (SEQ ID NO: 2151)
                        3'-CCUCCUCUGUACCACUUGGUCUCAAAG-5'    (SEQ ID NO: 516)
MYC-915 Target:         5'-GGAGGAGACATGGTGAACCAGAGTTTC-3'    (SEQ ID NO: 843)
```

TABLE 7-continued

Selected Human Anti-MYC "Blunt/Blunt" DsiRNAs

|  |  |  |
|---|---|---|
|  | 5'-GAGGAGACAUGGUGAACCAGAGUUUCA-3' | (SEQ ID NO: 2152) |
|  | 3'-CUCCUCUGUACCACUUGGUCUCAAAGU-5' | (SEQ ID NO: 517) |
| MYC-916 Target: | 5'-GAGGAGACATGGTGAACCAGAGTTTCA-3' | (SEQ ID NO: 844) |
|  | 5'-AGGAGACAUGGUGAACCAGAGUUUCAU-3' | (SEQ ID NO: 2153) |
|  | 3'-UCCUCUGUACCACUUGGUCUCAAAGUA-5' | (SEQ ID NO: 518) |
| MYC-917 Target: | 5'-AGGAGACATGGTGAACCAGAGTTTCAT-3' | (SEQ ID NO: 845) |
|  | 5'-CGGACGACGAGACCUUCAUCAAAAACA-3' | (SEQ ID NO: 2154) |
|  | 3'-GCCUGCUGCUCUGGAAGUAGUUUUUGU-5' | (SEQ ID NO: 519) |
| MYC-952 Target: | 5'-CGGACGACGAGACCTTCATCAAAAACA-3' | (SEQ ID NO: 846) |
|  | 5'-GGACGACGAGACCUUCAUCAAAAACAU-3' | (SEQ ID NO: 2155) |
|  | 3'-CCUGCUGCUCUGGAAGUAGUUUUUGUA-5' | (SEQ ID NO: 520) |
| MYC-953 Target: | 5'-GGACGACGAGACCTTCATCAAAAACAT-3' | (SEQ ID NO: 847) |
|  | 5'-AAAACAUCAUCAUCCAGGACUGUAUGU-3' | (SEQ ID NO: 2156) |
|  | 3'-UUUUGUAGUAGUAGGUCCUGACAUACA-5' | (SEQ ID NO: 521) |
| MYC-973 Target: | 5'-AAAACATCATCATCCAGGACTGTATGT-3' | (SEQ ID NO: 848) |
|  | 5'-AAACAUCAUCAUCCAGGACUGUAUGUG-3' | (SEQ ID NO: 2157) |
|  | 3'-UUUGUAGUAGUAGGUCCUGACAUACAC-5' | (SEQ ID NO: 522) |
| MYC-974 Target: | 5'-AAACATCATCATCCAGGACTGTATGTG-3' | (SEQ ID NO: 849) |
|  | 5'-AACAUCAUCAUCCAGGACUGUAUGUGG-3' | (SEQ ID NO: 2158) |
|  | 3'-UUGUAGUAGUAGGUCCUGACAUACACC-5' | (SEQ ID NO: 523) |
| MYC-975 Target: | 5'-AACATCATCATCCAGGACTGTATGTGG-3' | (SEQ ID NO: 850) |
|  | 5'-ACAUCAUCAUCCAGGACUGUAUGUGGA-3' | (SEQ ID NO: 2159) |
|  | 3'-UGUAGUAGUAGGUCCUGACAUACACCU-5' | (SEQ ID NO: 524) |
| MYC-976 Target: | 5'-ACATCATCATCCAGGACTGTATGTGGA-3' | (SEQ ID NO: 851) |
|  | 5'-CAUCAUCAUCCAGGACUGUAUGUGGAG-3' | (SEQ ID NO: 2160) |
|  | 3'-GUAGUAGUAGGUCCUGACAUACACCUC-5' | (SEQ ID NO: 525) |
| MYC-977 Target: | 5'-CATCATCATCCAGGACTGTATGTGGAG-3' | (SEQ ID NO: 852) |
|  | 5'-AUCAUCAUCCAGGACUGUAUGUGGAGC-3' | (SEQ ID NO: 2161) |
|  | 3'-UAGUAGUAGGUCCUGACAUACACCUCG-5' | (SEQ ID NO: 526) |
| MYC-978 Target: | 5'-ATCATCATCCAGGACTGTATGTGGAGC-3' | (SEQ ID NO: 853) |
|  | 5'-UCAUCAUCCAGGACUGUAUGUGGAGCG-3' | (SEQ ID NO: 2162) |
|  | 3'-AGUAGUAGGUCCUGACAUACACCUCGC-5' | (SEQ ID NO: 527) |
| MYC-979 Target: | 5'-TCATCATCCAGGACTGTATGTGGAGCG-3' | (SEQ ID NO: 854) |
|  | 5'-CAUCAUCCAGGACUGUAUGUGGAGCGG-3' | (SEQ ID NO: 2163) |
|  | 3'-GUAGUAGGUCCUGACAUACACCUCGCC-5' | (SEQ ID NO: 528) |
| MYC-980 Target: | 5'-CATCATCCAGGACTGTATGTGGAGCGG-3' | (SEQ ID NO: 855) |
|  | 5'-AUCAUCCAGGACUGUAUGUGGAGCGGC-3' | (SEQ ID NO: 2164) |
|  | 3'-UAGUAGGUCCUGACAUACACCUCGCCG-5' | (SEQ ID NO: 529) |
| MYC-981 Target: | 5'-ATCATCCAGGACTGTATGTGGAGCGGC-3' | (SEQ ID NO: 856) |

TABLE 7-continued

Selected Human Anti-MYC "Blunt/Blunt" DsiRNAs

```
                    5'-UCAUCCAGGACUGUAUGUGGAGCGGCU-3'    (SEQ ID NO: 2165)
                    3'-AGUAGGUCCUGACAUACACCUCGCCGA-5'    (SEQ ID NO: 530)
MYC-982  Target:    5'-TCATCCAGGACTGTATGTGGAGCGGCT-3'    (SEQ ID NO: 857)
                    5'-CAUCCAGGACUGUAUGUGGAGCGGCUU-3'   (SEQ ID NO: 2166)
                    3'-GUAGGUCCUGACAUACACCUCGCCGAA-5'   (SEQ ID NO: 531)
MYC-983  Target:    5'-CATCCAGGACTGTATGTGGAGCGGCTT-3'   (SEQ ID NO: 858)
                    5'-AUCCAGGACUGUAUGUGGAGCGGCUUC-3'   (SEQ ID NO: 2167)
                    3'-UAGGUCCUGACAUACACCUCGCCGAAG-5'   (SEQ ID NO: 532)
MYC-984  Target:    5'-ATCCAGGACTGTATGTGGAGCGGCTTC-3'   (SEQ ID NO: 859)
                    5'-UCCAGGACUGUAUGUGGAGCGGCUUCU-3'   (SEQ ID NO: 2168)
                    3'-AGGUCCUGACAUACACCUCGCCGAAGA-5'   (SEQ ID NO: 533)
MYC-985  Target:    5'-TCCAGGACTGTATGTGGAGCGGCTTCT-3'   (SEQ ID NO: 860)
                    5'-CCAGGACUGUAUGUGGAGCGGCUUCUC-3'   (SEQ ID NO: 2169)
                    3'-GGUCCUGACAUACACCUCGCCGAAGAG-5'   (SEQ ID NO: 534)
MYC-986  Target:    5'-CCAGGACTGTATGTGGAGCGGCTTCTC-3'   (SEQ ID NO: 861)
                    5'-CAGAGAAGCUGGCCUCCUACCAGGCUG-3'   (SEQ ID NO: 2170)
                    3'-GUCUCUUCGACCGGAGGAUGGUCCGAC-5'   (SEQ ID NO: 535)
MYC-1033 Target:    5'-CAGAGAAGCTGGCCTCCTACCAGGCTG-3'   (SEQ ID NO: 862)
                    5'-AGAGAAGCUGGCCUCCUACCAGGCUGC-3'   (SEQ ID NO: 2171)
                    3'-UCUCUUCGACCGGAGGAUGGUCCGACG-5'   (SEQ ID NO: 536)
MYC-1034 Target:    5'-AGAGAAGCTGGCCTCCTACCAGGCTGC-3'   (SEQ ID NO: 863)
                    5'-GAGAAGCUGGCCUCCUACCAGGCUGCG-3'   (SEQ ID NO: 2172)
                    3'-CUCUUCGACCGGAGGAUGGUCCGACGC-5'   (SEQ ID NO: 537)
MYC-1035 Target:    5'-GAGAAGCTGGCCTCCTACCAGGCTGCG-3'   (SEQ ID NO: 864)
                    5'-AGAAGCUGGCCUCCUACCAGGCUGCGC-3'   (SEQ ID NO: 2173)
                    3'-UCUUCGACCGGAGGAUGGUCCGACGCG-5'   (SEQ ID NO: 538)
MYC-1036 Target:    5'-AGAAGCTGGCCTCCTACCAGGCTGCGC-3'   (SEQ ID NO: 865)
                    5'-GAAGCUGGCCUCCUACCAGGCUGCGCG-3'   (SEQ ID NO: 2174)
                    3'-CUUCGACCGGAGGAUGGUCCGACGCGC-5'   (SEQ ID NO: 539)
MYC-1037 Target:    5'-GAAGCTGGCCTCCTACCAGGCTGCGCG-3'   (SEQ ID NO: 866)
                    5'-AAGCUGGCCUCCUACCAGGCUGCGCGC-3'   (SEQ ID NO: 2175)
                    3'-UUCGACCGGAGGAUGGUCCGACGCGCG-5'   (SEQ ID NO: 540)
MYC-1038 Target:    5'-AAGCTGGCCTCCTACCAGGCTGCGCGC-3'   (SEQ ID NO: 867)
                    5'-AGCUGGCCUCCUACCAGGCUGCGCGCA-3'   (SEQ ID NO: 2176)
                    3'-UCGACCGGAGGAUGGUCCGACGCGCGU-5'   (SEQ ID NO: 541)
MYC-1039 Target:    5'-AGCTGGCCTCCTACCAGGCTGCGCGCA-3'   (SEQ ID NO: 868)
                    5'-GCUGGCCUCCUACCAGGCUGCGCGCAA-3'   (SEQ ID NO: 2177)
                    3'-CGACCGGAGGAUGGUCCGACGCGCGUU-5'   (SEQ ID NO: 542)
MYC-1040 Target:    5'-GCTGGCCTCCTACCAGGCTGCGCGCAA-3'   (SEQ ID NO: 869)
```

TABLE 7-continued

Selected Human Anti-MYC "Blunt/Blunt" DsiRNAs

```
                  5'-CUGGCCUCCUACCAGGCUGCGCGCAAA-3'    (SEQ ID NO: 2178)
                  3'-GACCGGAGGAUGGUCCGACGCGCGUUU-5'    (SEQ ID NO: 543)
MYC-1041 Target:  5'-CTGGCCTCCTACCAGGCTGCGCGCAAA-3'    (SEQ ID NO: 870)
                  5'-UGGCCUCCUACCAGGCUGCGCGCAAAG-3'   (SEQ ID NO: 2179)
                  3'-ACCGGAGGAUGGUCCGACGCGCGUUUC-5'   (SEQ ID NO: 544)
MYC-1042 Target:  5'-TGGCCTCCTACCAGGCTGCGCGCAAAG-3'    (SEQ ID NO: 871)
                  5'-GGCCUCCUACCAGGCUGCGCGCAAAGA-3'   (SEQ ID NO: 2180)
                  3'-CCGGAGGAUGGUCCGACGCGCGUUUCU-5'   (SEQ ID NO: 545)
MYC-1043 Target:  5'-GGCCTCCTACCAGGCTGCGCGCAAAGA-3'    (SEQ ID NO: 872)
                  5'-GCCUCCUACCAGGCUGCGCGCAAAGAC-3'   (SEQ ID NO: 2181)
                  3'-CGGAGGAUGGUCCGACGCGCGUUUCUG-5'   (SEQ ID NO: 546)
MYC-1044 Target:  5'-GCCTCCTACCAGGCTGCGCGCAAAGAC-3'    (SEQ ID NO: 873)
                  5'-CCUCCUACCAGGCUGCGCGCAAAGACA-3'   (SEQ ID NO: 2182)
                  3'-GGAGGAUGGUCCGACGCGCGUUUCUGU-5'   (SEQ ID NO: 547)
MYC-1045 Target:  5'-CCTCCTACCAGGCTGCGCGCAAAGACA-3'    (SEQ ID NO: 874)
                  5'-CUCCUACCAGGCUGCGCGCAAAGACAG-3'   (SEQ ID NO: 2183)
                  3'-GAGGAUGGUCCGACGCGCGUUUCUGUC-5'   (SEQ ID NO: 548)
MYC-1046 Target:  5'-CTCCTACCAGGCTGCGCGCAAAGACAG-3'    (SEQ ID NO: 875)
                  5'-UCCUACCAGGCUGCGCGCAAAGACAGC-3'   (SEQ ID NO: 2184)
                  3'-AGGAUGGUCCGACGCGCGUUUCUGUCG-5'   (SEQ ID NO: 549)
MYC-1047 Target:  5'-TCCTACCAGGCTGCGCGCAAAGACAGC-3'    (SEQ ID NO: 876)
                  5'-CCUACCAGGCUGCGCGCAAAGACAGCG-3'   (SEQ ID NO: 2185)
                  3'-GGAUGGUCCGACGCGCGUUUCUGUCGC-5'   (SEQ ID NO: 550)
MYC-1048 Target:  5'-CCTACCAGGCTGCGCGCAAAGACAGCG-3'    (SEQ ID NO: 877)
                  5'-CUACCAGGCUGCGCGCAAAGACAGCGG-3'   (SEQ ID NO: 2186)
                  3'-GAUGGUCCGACGCGCGUUUCUGUCGCC-5'   (SEQ ID NO: 551)
MYC-1049 Target:  5'-CTACCAGGCTGCGCGCAAAGACAGCGG-3'    (SEQ ID NO: 878)
                  5'-UACCAGGCUGCGCGCAAAGACAGCGGC-3'   (SEQ ID NO: 2187)
                  3'-AUGGUCCGACGCGCGUUUCUGUCGCCG-5'   (SEQ ID NO: 552)
MYC-1050 Target:  5'-TACCAGGCTGCGCGCAAAGACAGCGGC-3'    (SEQ ID NO: 879)
                  5'-ACCAGGCUGCGCGCAAAGACAGCGGCA-3'   (SEQ ID NO: 2188)
                  3'-UGGUCCGACGCGCGUUUCUGUCGCCGU-5'   (SEQ ID NO: 553)
MYC-1051 Target:  5'-ACCAGGCTGCGCGCAAAGACAGCGGCA-3'    (SEQ ID NO: 880)
                  5'-CCAGGCUGCGCGCAAAGACAGCGGCAG-3'   (SEQ ID NO: 2189)
                  3'-GGUCCGACGCGCGUUUCUGUCGCCGUC-5'   (SEQ ID NO: 554)
MYC-1052 Target:  5'-CCAGGCTGCGCGCAAAGACAGCGGCAG-3'    (SEQ ID NO: 881)
                  5'-CAGGCUGCGCGCAAAGACAGCGGCAGC-3'   (SEQ ID NO: 2190)
                  3'-GUCCGACGCGCGUUUCUGUCGCCGUCG-5'   (SEQ ID NO: 555)
MYC-1053 Target:  5'-CAGGCTGCGCGCAAAGACAGCGGCAGC-3'    (SEQ ID NO: 882)
```

TABLE 7-continued

Selected Human Anti-MYC "Blunt/Blunt" DsiRNAs

```
              5'-GCCACAGCGUCUGCUCCACCUCCAGCU-3'  (SEQ ID NO: 2191)
              3'-CGGUGUCGCAGACGAGGUGGAGGUCGA-5'  (SEQ ID NO: 556)
MYC-1096 Target: 5'-GCCACAGCGTCTGCTCCACCTCCAGCT-3'  (SEQ ID NO: 883)
              5'-CCACAGCGUCUGCUCCACCUCCAGCUU-3'  (SEQ ID NO: 2192)
              3'-GGUGUCGCAGACGAGGUGGAGGUCGAA-5'  (SEQ ID NO: 557)
MYC-1097 Target: 5'-CCACAGCGTCTGCTCCACCTCCAGCTT-3'  (SEQ ID NO: 884)
              5'-CACAGCGUCUGCUCCACCUCCAGCUUG-3'  (SEQ ID NO: 2193)
              3'-GUGUCGCAGACGAGGUGGAGGUCGAAC-5'  (SEQ ID NO: 558)
MYC-1098 Target: 5'-CACAGCGTCTGCTCCACCTCCAGCTTG-3'  (SEQ ID NO: 885)
              5'-ACAGCGUCUGCUCCACCUCCAGCUUGU-3'  (SEQ ID NO: 2194)
              3'-UGUCGCAGACGAGGUGGAGGUCGAACA-5'  (SEQ ID NO: 559)
MYC-1099 Target: 5'-ACAGCGTCTGCTCCACCTCCAGCTTGT-3'  (SEQ ID NO: 886)
              5'-CAGCGUCUGCUCCACCUCCAGCUUGUA-3'  (SEQ ID NO: 2195)
              3'-GUCGCAGACGAGGUGGAGGUCGAACAU-5'  (SEQ ID NO: 560)
MYC-1100 Target: 5'-CAGCGTCTGCTCCACCTCCAGCTTGTA-3'  (SEQ ID NO: 887)
              5'-AGCGUCUGCUCCACCUCCAGCUUGUAC-3'  (SEQ ID NO: 2196)
              3'-UCGCAGACGAGGUGGAGGUCGAACAUG-5'  (SEQ ID NO: 561)
MYC-1101 Target: 5'-AGCGTCTGCTCCACCTCCAGCTTGTAC-3'  (SEQ ID NO: 888)
              5'-CUCUCAACGACAGCAGCUCGCCCAAGU-3'  (SEQ ID NO: 2197)
              3'-GAGAGUUGCUGUCGUCGAGCGGGUUCA-5'  (SEQ ID NO: 562)
MYC-1189 Target: 5'-CTCTCAACGACAGCAGCTCGCCCAAGT-3'  (SEQ ID NO: 889)
              5'-UCUCAACGACAGCAGCUCGCCCAAGUC-3'  (SEQ ID NO: 2198)
              3'-AGAGUUGCUGUCGUCGAGCGGGUUCAG-5'  (SEQ ID NO: 563)
MYC-1190 Target: 5'-TCTCAACGACAGCAGCTCGCCCAAGTC-3'  (SEQ ID NO: 890)
              5'-CUCAACGACAGCAGCUCGCCCAAGUCC-3'  (SEQ ID NO: 2199)
              3'-GAGUUGCUGUCGUCGAGCGGGUUCAGG-5'  (SEQ ID NO: 564)
MYC-1191 Target: 5'-CTCAACGACAGCAGCTCGCCCAAGTCC-3'  (SEQ ID NO: 891)
              5'-UCAACGACAGCAGCUCGCCCAAGUCCU-3'  (SEQ ID NO: 2200)
              3'-AGUUGCUGUCGUCGAGCGGGUUCAGGA-5'  (SEQ ID NO: 565)
MYC-1192 Target: 5'-TCAACGACAGCAGCTCGCCCAAGTCCT-3'  (SEQ ID NO: 892)
              5'-CAACGACAGCAGCUCGCCCAAGUCCUG-3'  (SEQ ID NO: 2201)
              3'-GUUGCUGUCGUCGAGCGGGUUCAGGAC-5'  (SEQ ID NO: 566)
MYC-1193 Target: 5'-CAACGACAGCAGCTCGCCCAAGTCCTG-3'  (SEQ ID NO: 893)
              5'-UCCAUGAGGAGACACCGCCCACCACCA-3'  (SEQ ID NO: 2202)
              3'-AGGUACUCCUCUGUGGCGGGUGGUGGU-5'  (SEQ ID NO: 567)
MYC-1315 Target: 5'-TCCATGAGGAGACACCGCCCACCACCA-3'  (SEQ ID NO: 894)
              5'-CCAUGAGGAGACACCGCCCACCACCAG-3'  (SEQ ID NO: 2203)
              3'-GGUACUCCUCUGUGGCGGGUGGUGGUC-5'  (SEQ ID NO: 568)
MYC-1316 Target: 5'-CCATGAGGAGACACCGCCCACCACCAG-3'  (SEQ ID NO: 895)
```

TABLE 7-continued

Selected Human Anti-MYC "Blunt/Blunt" DsiRNAs

```
                   5'-CAUGAGGAGACACCGCCCACCACCAGC-3'    (SEQ ID NO: 2204)
                   3'-GUACUCCUCUGUGGCGGGUGGUGGUCG-5'    (SEQ ID NO: 569)
MYC-1317 Target:   5'-CATGAGGAGACACCGCCCACCACCAGC-3'    (SEQ ID NO: 896)
                   5'-AUGAGGAGACACCGCCCACCACCAGCA-3'    (SEQ ID NO: 2205)
                   3'-UACUCCUCUGUGGCGGGUGGUGGUCGU-5'    (SEQ ID NO: 570)
MYC-1318 Target:   5'-ATGAGGAGACACCGCCCACCACCAGCA-3'    (SEQ ID NO: 897)
                   5'-UGAGGAGACACCGCCCACCACCAGCAG-3'    (SEQ ID NO: 2206)
                   3'-ACUCCUCUGUGGCGGGUGGUGGUCGUC-5'    (SEQ ID NO: 571)
MYC-1319 Target:   5'-TGAGGAGACACCGCCCACCACCAGCAG-3'    (SEQ ID NO: 898)
                   5'-GAGGAGACACCGCCCACCACCAGCAGC-3'    (SEQ ID NO: 2207)
                   3'-CUCCUCUGUGGCGGGUGGUGGUCGUCG-5'    (SEQ ID NO: 572)
MYC-1320 Target:   5'-GAGGAGACACCGCCCACCACCAGCAGC-3'    (SEQ ID NO: 899)
                   5'-AGGAGACACCGCCCACCACCAGCAGCG-3'    (SEQ ID NO: 2208)
                   3'-UCCUCUGUGGCGGGUGGUGGUCGUCGC-5'    (SEQ ID NO: 573)
MYC-1321 Target:   5'-AGGAGACACCGCCCACCACCAGCAGCG-3'    (SEQ ID NO: 900)
                   5'-GGAGACACCGCCCACCACCAGCAGCGA-3'    (SEQ ID NO: 2209)
                   3'-CCUCUGUGGCGGGUGGUGGUCGUCGCU-5'    (SEQ ID NO: 574)
MYC-1322 Target:   5'-GGAGACACCGCCCACCACCAGCAGCGA-3'    (SEQ ID NO: 901)
                   5'-GAGACACCGCCCACCACCAGCAGCGAC-3'    (SEQ ID NO: 2210)
                   3'-CUCUGUGGCGGGUGGUGGUCGUCGCUG-5'    (SEQ ID NO: 575)
MYC-1323 Target:   5'-GAGACACCGCCCACCACCAGCAGCGAC-3'    (SEQ ID NO: 902)
                   5'-AGACACCGCCCACCACCAGCAGCGACU-3'    (SEQ ID NO: 2211)
                   3'-UCUGUGGCGGGUGGUGGUCGUCGCUGA-5'    (SEQ ID NO: 576)
MYC-1324 Target:   5'-AGACACCGCCCACCACCAGCAGCGACT-3'    (SEQ ID NO: 903)
                   5'-GACACCGCCCACCACCAGCAGCGACUC-3'    (SEQ ID NO: 2212)
                   3'-CUGUGGCGGGUGGUGGUCGUCGCUGAG-5'    (SEQ ID NO: 577)
MYC-1325 Target:   5'-GACACCGCCCACCACCAGCAGCGACTC-3'    (SEQ ID NO: 904)
                   5'-ACACCGCCCACCACCAGCAGCGACUCU-3'    (SEQ ID NO: 2213)
                   3'-UGUGGCGGGUGGUGGUCGUCGCUGAGA-5'    (SEQ ID NO: 578)
MYC-1326 Target:   5'-ACACCGCCCACCACCAGCAGCGACTCT-3'    (SEQ ID NO: 905)
                   5'-CACCGCCCACCACCAGCAGCGACUCUG-3'    (SEQ ID NO: 2214)
                   3'-GUGGCGGGUGGUGGUCGUCGCUGAGAC-5'    (SEQ ID NO: 579)
MYC-1327 Target:   5'-CACCGCCCACCACCAGCAGCGACTCTG-3'    (SEQ ID NO: 906)
                   5'-ACCGCCCACCACCAGCAGCGACUCUGA-3'    (SEQ ID NO: 2215)
                   3'-UGGCGGGUGGUGGUCGUCGCUGAGACU-5'    (SEQ ID NO: 580)
MYC-1328 Target:   5'-ACCGCCCACCACCAGCAGCGACTCTGA-3'    (SEQ ID NO: 907)
                   5'-CCGCCCACCACCAGCAGCGACUCUGAG-3'    (SEQ ID NO: 2216)
                   3'-GGCGGGUGGUGGUCGUCGCUGAGACUC-5'    (SEQ ID NO: 581)
MYC-1329 Target:   5'-CCGCCCACCACCAGCAGCGACTCTGAG-3'    (SEQ ID NO: 908)
```

TABLE 7-continued

Selected Human Anti-MYC "Blunt/Blunt" DsiRNAs

```
                    5'-CGCCCACCACCAGCAGCGACUCUGAGG-3'      (SEQ ID NO: 2217)
                    3'-GCGGGUGGUGGUCGUCGCUGAGACUCC-5'      (SEQ ID NO: 582)
MYC-1330 Target: 5'-CGCCCACCACCAGCAGCGACTCTGAGG-3'         (SEQ ID NO: 909)
                    5'-GCCCACCACCAGCAGCGACUCUGAGGA-3'      (SEQ ID NO: 2218)
                    3'-CGGGUGGUGGUCGUCGCUGAGACUCCU-5'      (SEQ ID NO: 583)
MYC-1331 Target: 5'-GCCCACCACCAGCAGCGACTCTGAGGA-3'         (SEQ ID NO: 910)
                    5'-CCCACCACCAGCAGCGACUCUGAGGAG-3'      (SEQ ID NO: 2219)
                    3'-GGGUGGUGGUCGUCGCUGAGACUCCUC-5'      (SEQ ID NO: 584)
MYC-1332 Target: 5'-CCCACCACCAGCAGCGACTCTGAGGAG-3'         (SEQ ID NO: 911)
                    5'-CCACCACCAGCAGCGACUCUGAGGAGG-3'      (SEQ ID NO: 2220)
                    3'-GGUGGUGGUCGUCGCUGAGACUCCUCC-5'      (SEQ ID NO: 585)
MYC-1333 Target: 5'-CCACCACCAGCAGCGACTCTGAGGAGG-3'         (SEQ ID NO: 912)
                    5'-CACCACCAGCAGCGACUCUGAGGAGGA-3'      (SEQ ID NO: 2221)
                    3'-GUGGUGGUCGUCGCUGAGACUCCUCCU-5'      (SEQ ID NO: 586)
MYC-1334 Target: 5'-CACCACCAGCAGCGACTCTGAGGAGGA-3'         (SEQ ID NO: 913)
                    5'-AACAAGAAGAUGAGGAAGAAAUCGAUG-3'      (SEQ ID NO: 2222)
                    3'-UUGUUCUUCUACUCCUUCUUUAGCUAC-5'      (SEQ ID NO: 587)
MYC-1360 Target: 5'-AACAAGAAGATGAGGAAGAAATCGATG-3'         (SEQ ID NO: 914)
                    5'-ACAAGAAGAUGAGGAAGAAAUCGAUGU-3'      (SEQ ID NO: 2223)
                    3'-UGUUCUUCUACUCCUUCUUUAGCUACA-5'      (SEQ ID NO: 588)
MYC-1361 Target: 5'-ACAAGAAGATGAGGAAGAAATCGATGT-3'         (SEQ ID NO: 915)
                    5'-UGGAGGCCACAGCAAACCUCCUCACAG-3'      (SEQ ID NO: 2224)
                    3'-ACCUCCGGUGUCGUUUGGAGGAGUGUC-5'      (SEQ ID NO: 589)
MYC-1448 Target: 5'-TGGAGGCCACAGCAAACCTCCTCACAG-3'         (SEQ ID NO: 916)
                    5'-CUCACAGCCCACUGGUCCUCAAGAGGU-3'      (SEQ ID NO: 2225)
                    3'-GAGUGUCGGGUGACCAGGAGUUCUCCA-5'      (SEQ ID NO: 590)
MYC-1468 Target: 5'-CTCACAGCCCACTGGTCCTCAAGAGGT-3'         (SEQ ID NO: 917)
                    5'-UCACAGCCCACUGGUCCUCAAGAGGUG-3'      (SEQ ID NO: 2226)
                    3'-AGUGUCGGGUGACCAGGAGUUCUCCAC-5'      (SEQ ID NO: 591)
MYC-1469 Target: 5'-TCACAGCCCACTGGTCCTCAAGAGGTG-3'         (SEQ ID NO: 918)
                    5'-CACAGCCCACUGGUCCUCAAGAGGUGC-3'      (SEQ ID NO: 2227)
                    3'-GUGUCGGGUGACCAGGAGUUCUCCACG-5'      (SEQ ID NO: 592)
MYC-1470 Target: 5'-CACAGCCCACTGGTCCTCAAGAGGTGC-3'         (SEQ ID NO: 919)
                    5'-ACAGCCCACUGGUCCUCAAGAGGUGCC-3'      (SEQ ID NO: 2228)
                    3'-UGUCGGGUGACCAGGAGUUCUCCACGG-5'      (SEQ ID NO: 593)
MYC-1471 Target: 5'-ACAGCCCACTGGTCCTCAAGAGGTGCC-3'         (SEQ ID NO: 920)
                    5'-CAGCCCACUGGUCCUCAAGAGGUGCCA-3'      (SEQ ID NO: 2229)
                    3'-GUCGGGUGACCAGGAGUUCUCCACGGU-5'      (SEQ ID NO: 594)
MYC-1472 Target: 5'-CAGCCCACTGGTCCTCAAGAGGTGCCA-3'         (SEQ ID NO: 921)
```

TABLE 7-continued

Selected Human Anti-MYC "Blunt/Blunt" DsiRNAs

```
                 5'-AGCCCACUGGUCCUCAAGAGGUGCCAC-3'   (SEQ ID NO: 2230)
                 3'-UCGGGUGACCAGGAGUUCUCCACGGUG-5'   (SEQ ID NO: 595)
MYC-1473 Target: 5'-AGCCCACTGGTCCTCAAGAGGTGCCAC-3'   (SEQ ID NO: 922)
                 5'-GCCCACUGGUCCUCAAGAGGUGCCACG-3'   (SEQ ID NO: 2231)
                 3'-CGGGUGACCAGGAGUUCUCCACGGUGC-5'   (SEQ ID NO: 596)
MYC-1474 Target: 5'-GCCCACTGGTCCTCAAGAGGTGCCACG-3'   (SEQ ID NO: 923)
                 5'-CCCACUGGUCCUCAAGAGGUGCCACGU-3'   (SEQ ID NO: 2232)
                 3'-GGGUGACCAGGAGUUCUCCACGGUGCA-5'   (SEQ ID NO: 597)
MYC-1475 Target: 5'-CCCACTGGTCCTCAAGAGGTGCCACGT-3'   (SEQ ID NO: 924)
                 5'-CCACUGGUCCUCAAGAGGUGCCACGUC-3'   (SEQ ID NO: 2233)
                 3'-GGUGACCAGGAGUUCUCCACGGUGCAG-5'   (SEQ ID NO: 598)
MYC-1476 Target: 5'-CCACTGGTCCTCAAGAGGTGCCACGTC-3'   (SEQ ID NO: 925)
                 5'-CACUGGUCCUCAAGAGGUGCCACGUCU-3'   (SEQ ID NO: 2234)
                 3'-GUGACCAGGAGUUCUCCACGGUGCAGA-5'   (SEQ ID NO: 599)
MYC-1477 Target: 5'-CACTGGTCCTCAAGAGGTGCCACGTCT-3'   (SEQ ID NO: 926)
                 5'-ACUGGUCCUCAAGAGGUGCCACGUCUC-3'   (SEQ ID NO: 2235)
                 3'-UGACCAGGAGUUCUCCACGGUGCAGAG-5'   (SEQ ID NO: 600)
MYC-1478 Target: 5'-ACTGGTCCTCAAGAGGTGCCACGTCTC-3'   (SEQ ID NO: 927)
                 5'-CUGGUCCUCAAGAGGUGCCACGUCUCC-3'   (SEQ ID NO: 2236)
                 3'-GACCAGGAGUUCUCCACGGUGCAGAGG-5'   (SEQ ID NO: 601)
MYC-1479 Target: 5'-CTGGTCCTCAAGAGGTGCCACGTCTCC-3'   (SEQ ID NO: 928)
                 5'-UGGUCCUCAAGAGGUGCCACGUCUCCA-3'   (SEQ ID NO: 2237)
                 3'-ACCAGGAGUUCUCCACGGUGCAGAGGU-5'   (SEQ ID NO: 602)
MYC-1480 Target: 5'-TGGTCCTCAAGAGGTGCCACGTCTCCA-3'   (SEQ ID NO: 929)
                 5'-GGUCCUCAAGAGGUGCCACGUCUCCAC-3'   (SEQ ID NO: 2238)
                 3'-CCAGGAGUUCUCCACGGUGCAGAGGUG-5'   (SEQ ID NO: 603)
MYC-1481 Target: 5'-GGTCCTCAAGAGGTGCCACGTCTCCAC-3'   (SEQ ID NO: 930)
                 5'-GUCCUCAAGAGGUGCCACGUCUCCACA-3'   (SEQ ID NO: 2239)
                 3'-CAGGAGUUCUCCACGGUGCAGAGGUGU-5'   (SEQ ID NO: 604)
MYC-1482 Target: 5'-GTCCTCAAGAGGTGCCACGTCTCCACA-3'   (SEQ ID NO: 931)
                 5'-UCCUCAAGAGGUGCCACGUCUCCACAC-3'   (SEQ ID NO: 2240)
                 3'-AGGAGUUCUCCACGGUGCAGAGGUGUG-5'   (SEQ ID NO: 605)
MYC-1483 Target: 5'-TCCTCAAGAGGTGCCACGTCTCCACAC-3'   (SEQ ID NO: 932)
                 5'-GGAGCUUUUUUGCCCUGCGUGACCAGA-3'   (SEQ ID NO: 2241)
                 3'-CCUCGAAAAAACGGGACGCACUGGUCU-5'   (SEQ ID NO: 606)
MYC-1711 Target: 5'-GGAGCTTTTTTGCCCTGCGTGACCAGA-3'   (SEQ ID NO: 933)
                 5'-GAGCUUUUUUGCCCUGCGUGACCAGAU-3'   (SEQ ID NO: 2242)
                 3'-CUCGAAAAAACGGGACGCACUGGUCUA-5'   (SEQ ID NO: 607)
MYC-1712 Target: 5'-GAGCTTTTTTGCCCTGCGTGACCAGAT-3'   (SEQ ID NO: 934)
```

TABLE 7-continued

Selected Human Anti-MYC "Blunt/Blunt" DsiRNAs

|  |  |  |
|---|---|---|
|  | 5'-AGCUUUUUUGCCCUGCGUGACCAGAUC-3' | (SEQ ID NO: 2243) |
|  | 3'-UCGAAAAAACGGGACGCACUGGUCUAG-5' | (SEQ ID NO: 608) |
| MYC-1713 Target: | 5'-AGCTTTTTTGCCCTGCGTGACCAGATC-3' | (SEQ ID NO: 935) |
|  | 5'-GCUUUUUUGCCCUGCGUGACCAGAUCC-3' | (SEQ ID NO: 2244) |
|  | 3'-CGAAAAAACGGGACGCACUGGUCUAGG-5' | (SEQ ID NO: 609) |
| MYC-1714 Target: | 5'-GCTTTTTTGCCCTGCGTGACCAGATCC-3' | (SEQ ID NO: 936) |
|  | 5'-CUUUUUUGCCCUGCGUGACCAGAUCCC-3' | (SEQ ID NO: 2245) |
|  | 3'-GAAAAAACGGGACGCACUGGUCUAGGG-5' | (SEQ ID NO: 610) |
| MYC-1715 Target: | 5'-CTTTTTTGCCCTGCGTGACCAGATCCC-3' | (SEQ ID NO: 937) |
|  | 5'-UUUUUUGCCCUGCGUGACCAGAUCCCG-3' | (SEQ ID NO: 2246) |
|  | 3'-AAAAAACGGGACGCACUGGUCUAGGGC-5' | (SEQ ID NO: 611) |
| MYC-1716 Target: | 5'-TTTTTTGCCCTGCGTGACCAGATCCCG-3' | (SEQ ID NO: 938) |
|  | 5'-UUUUGCCCUGCGUGACCAGAUCCCGG-3' | (SEQ ID NO: 2247) |
|  | 3'-AAAAACGGGACGCACUGGUCUAGGGCC-5' | (SEQ ID NO: 612) |
| MYC-1717 Target: | 5'-TTTTTGCCCTGCGTGACCAGATCCCGG-3' | (SEQ ID NO: 939) |
|  | 5'-UUUUGCCCUGCGUGACCAGAUCCCGGA-3' | (SEQ ID NO: 2248) |
|  | 3'-AAAACGGGACGCACUGGUCUAGGGCCU-5' | (SEQ ID NO: 613) |
| MYC-1718 Target: | 5'-TTTTGCCCTGCGTGACCAGATCCCGGA-3' | (SEQ ID NO: 940) |
|  | 5'-UUUGCCCUGCGUGACCAGAUCCCGGAG-3' | (SEQ ID NO: 2249) |
|  | 3'-AAACGGGACGCACUGGUCUAGGGCCUC-5' | (SEQ ID NO: 614) |
| MYC-1719 Target: | 5'-TTTGCCCTGCGTGACCAGATCCCGGAG-3' | (SEQ ID NO: 941) |
|  | 5'-UUGCCCUGCGUGACCAGAUCCCGGAGU-3' | (SEQ ID NO: 2250) |
|  | 3'-AACGGGACGCACUGGUCUAGGGCCUCA-5' | (SEQ ID NO: 615) |
| MYC-1720 Target: | 5'-TTGCCCTGCGTGACCAGATCCCGGAGT-3' | (SEQ ID NO: 942) |
|  | 5'-UGCCCUGCGUGACCAGAUCCCGGAGUU-3' | (SEQ ID NO: 2251) |
|  | 3'-ACGGGACGCACUGGUCUAGGGCCUCAA-5' | (SEQ ID NO: 616) |
| MYC-1721 Target: | 5'-TGCCCTGCGTGACCAGATCCCGGAGTT-3' | (SEQ ID NO: 943) |
|  | 5'-GCGGAAACGACGAGAACAGUUGAAACA-3' | (SEQ ID NO: 2252) |
|  | 3'-CGCCUUUGCUGCUCUUGUCAACUUUGU-5' | (SEQ ID NO: 617) |
| MYC-1856 Target: | 5'-GCGGAAACGACGAGAACAGTTGAAACA-3' | (SEQ ID NO: 944) |
|  | 5'-CGGAAACGACGAGAACAGUUGAAACAC-3' | (SEQ ID NO: 2253) |
|  | 3'-GCCUUUGCUGCUCUUGUCAACUUUGUG-5' | (SEQ ID NO: 618) |
| MYC-1857 Target: | 5'-CGGAAACGACGAGAACAGTTGAAACAC-3' | (SEQ ID NO: 945) |
|  | 5'-UCUUUAACAGAUUUGUAUUUAAGAAUU-3' | (SEQ ID NO: 2254) |
|  | 3'-AGAAAUUGUCUAAACAUAAAUUCUUAA-5' | (SEQ ID NO: 619) |
| MYC-2115 Target: | 5'-TCTTTAACAGATTTGTATTTAAGAATT-3' | (SEQ ID NO: 946) |
|  | 5'-CUUUAACAGAUUUGUAUUUAAGAAUUG-3' | (SEQ ID NO: 2255) |
|  | 3'-GAAAUUGUCUAAACAUAAAUUCUUAAC-5' | (SEQ ID NO: 620) |
| MYC-2116 Target: | 5'-CTTTAACAGATTTGTATTTAAGAATTG-3' | (SEQ ID NO: 947) |

TABLE 7-continued

Selected Human Anti-MYC "Blunt/Blunt" DsiRNAs

```
                 5'-UUAAAUGUAAAUAACUUUAAUAAAACG-3'   (SEQ ID NO: 2256)
                 3'-AAUUUACAUUUAUUGAAAUUAUUUUGC-5'   (SEQ ID NO: 621)
MYC-2193 Target: 5'-TTAAATGTAAATAACTTTAATAAAACG-3'   (SEQ ID NO: 948)
                 5'-UAAAUGUAAAUAACUUUAAUAAAACGU-3'   (SEQ ID NO: 2257)
                 3'-AUUUACAUUUAUUGAAAUUAUUUUGCA-5'   (SEQ ID NO: 622)
MYC-2194 Target: 5'-TAAATGTAAATAACTTTAATAAAACGT-3'   (SEQ ID NO: 949)
                 5'-AAAUGUAAAUAACUUUAAUAAAACGUU-3'   (SEQ ID NO: 2258)
                 3'-UUUACAUUUAUUGAAAUUAUUUUGCAA-5'   (SEQ ID NO: 623)
MYC-2195 Target: 5'-AAATGTAAATAACTTTAATAAAACGTT-3'   (SEQ ID NO: 950)
                 5'-AAUGUAAAUAACUUUAAUAAAACGUUU-3'   (SEQ ID NO: 2259)
                 3'-UUACAUUUAUUGAAAUUAUUUUGCAAA-5'   (SEQ ID NO: 624)
MYC-2196 Target: 5'-AATGTAAATAACTTTAATAAAACGTTT-3'   (SEQ ID NO: 951)
                 5'-AUGUAAAUAACUUUAAUAAAACGUUUA-3'   (SEQ ID NO: 2260)
                 3'-UACAUUUAUUGAAAUUAUUUUGCAAAU-5'   (SEQ ID NO: 625)
MYC-2197 Target: 5'-ATGTAAATAACTTTAATAAAACGTTTA-3'   (SEQ ID NO: 952)
                 5'-UGUAAAUAACUUUAAUAAAACGUUUAU-3'   (SEQ ID NO: 2261)
                 3'-ACAUUUAUUGAAAUUAUUUUGCAAAUA-5'   (SEQ ID NO: 626)
MYC-2198 Target: 5'-TGTAAATAACTTTAATAAAACGTTTAT-3'   (SEQ ID NO: 953)
                 5'-GUAAAUAACUUUAAUAAAACGUUUAUA-3'   (SEQ ID NO: 2262)
                 3'-CAUUUAUUGAAAUUAUUUUGCAAAUAU-5'   (SEQ ID NO: 627)
MYC-2199 Target: 5'-GTAAATAACTTTAATAAAACGTTTATA-3'   (SEQ ID NO: 954)
                 5'-UAAAUAACUUUAAUAAAACGUUUAUAG-3'   (SEQ ID NO: 2263)
                 3'-AUUUAUUGAAAUUAUUUUGCAAAUAUC-5'   (SEQ ID NO: 628)
MYC-2200 Target: 5'-TAAATAACTTTAATAAAACGTTTATAG-3'   (SEQ ID NO: 955)
                 5'-AAAUAACUUUAAUAAAACGUUUAUAGC-3'   (SEQ ID NO: 2264)
                 3'-UUUAUUGAAAUUAUUUUGCAAAUAUCG-5'   (SEQ ID NO: 629)
MYC-2201 Target: 5'-AAATAACTTTAATAAAACGTTTATAGC-3'   (SEQ ID NO: 956)
                 5'-AAUAACUUUAAUAAAACGUUUAUAGCA-3'   (SEQ ID NO: 2265)
                 3'-UUAUUGAAAUUAUUUUGCAAAUAUCGU-5'   (SEQ ID NO: 630)
MYC-2202 Target: 5'-AATAACTTTAATAAAACGTTTATAGCA-3'   (SEQ ID NO: 957)
                 5'-AUAACUUUAAUAAAACGUUUAUAGCAG-3'   (SEQ ID NO: 2266)
                 3'-UAUUGAAAUUAUUUUGCAAAUAUCGUC-5'   (SEQ ID NO: 631)
MYC-2203 Target: 5'-ATAACTTTAATAAAACGTTTATAGCAG-3'   (SEQ ID NO: 958)
                 5'-UAACUUUAAUAAAACGUUUAUAGCAGU-3'   (SEQ ID NO: 2267)
                 3'-AUUGAAAUUAUUUUGCAAAUAUCGUCA-5'   (SEQ ID NO: 632)
MYC-2204 Target: 5'-TAACTTTAATAAAACGTTTATAGCAGT-3'   (SEQ ID NO: 959)
                 5'-AACUUUAAUAAAACGUUUAUAGCAGUU-3'   (SEQ ID NO: 2268)
                 3'-UUGAAAUUAUUUUGCAAAUAUCGUCAA-5'   (SEQ ID NO: 633)
MYC-2205 Target: 5'-AACTTTAATAAAACGTTTATAGCAGTT-3'   (SEQ ID NO: 960)
```

TABLE 7-continued

Selected Human Anti-MYC "Blunt/Blunt" DsiRNAs

```
                      5'-GCUUUUUAAAGUUGAUUUUUUUCUAUU-3'    (SEQ ID NO: 2269)
                      3'-CGAAAAAUUUCAACUAAAAAAAGAUAA-5'    (SEQ ID NO: 634)
MYC-2313  Target:     5'-GCTTTTTAAAGTTGATTTTTTTCTATT-3'    (SEQ ID NO: 961)
                      5'-CUUUUUAAAGUUGAUUUUUUUCUAUUG-3'    (SEQ ID NO: 2270)
                      3'-GAAAAAUUUCAACUAAAAAAAGAUAAC-5'    (SEQ ID NO: 635)
MYC-2314  Target:     5'-CTTTTTAAAGTTGATTTTTTTCTATTG-3'    (SEQ ID NO: 962)
                      5'-UUUUUAAAGUUGAUUUUUUUCUAUUGU-3'    (SEQ ID NO: 2271)
                      3'-AAAAAUUUCAACUAAAAAAAGAUAACA-5'    (SEQ ID NO: 636)
MYC-2315  Target:     5'-TTTTTAAAGTTGATTTTTTTCTATTGT-3'    (SEQ ID NO: 963)
                      5'-UUUUAAAGUUGAUUUUUUUCUAUUGUU-3'    (SEQ ID NO: 2272)
                      3'-AAAAUUUCAACUAAAAAAAGAUAACAA-5'    (SEQ ID NO: 637)
MYC-2316  Target:     5'-TTTTAAAGTTGATTTTTTTCTATTGTT-3'    (SEQ ID NO: 964)
                      5'-UUUAAAGUUGAUUUUUUUCUAUUGUUU-3'    (SEQ ID NO: 2273)
                      3'-AAAUUUCAACUAAAAAAAGAUAACAAA-5'    (SEQ ID NO: 638)
MYC-2317  Target:     5'-TTTAAAGTTGATTTTTTTCTATTGTTT-3'    (SEQ ID NO: 965)
                      5'-UUAAAGUUGAUUUUUUUCUAUUGUUUU-3'    (SEQ ID NO: 2274)
                      3'-AAUUUCAACUAAAAAAAGAUAACAAAA-5'    (SEQ ID NO: 639)
MYC-2318  Target:     5'-TTAAAGTTGATTTTTTTCTATTGTTTT-3'    (SEQ ID NO: 966)
                      5'-UAAAGUUGAUUUUUUUCUAUUGUUUUU-3'    (SEQ ID NO: 2275)
                      3'-AUUUCAACUAAAAAAAGAUAACAAAAA-5'    (SEQ ID NO: 640)
MYC-2319  Target:     5'-TAAAGTTGATTTTTTTCTATTGTTTTT-3'    (SEQ ID NO: 967)
                      5'-AAAGUUGAUUUUUUUCUAUUGUUUUUA-3'    (SEQ ID NO: 2276)
                      3'-UUUCAACUAAAAAAAGAUAACAAAAAU-5'    (SEQ ID NO: 641)
MYC-2320  Target:     5'-AAAGTTGATTTTTTTCTATTGTTTTTA-3'    (SEQ ID NO: 968)
                      5'-AAGUUGAUUUUUUUCUAUUGUUUUUAG-3'    (SEQ ID NO: 2277)
                      3'-UUCAACUAAAAAAAGAUAACAAAAAUC-5'    (SEQ ID NO: 642)
MYC-2321  Target:     5'-AAGTTGATTTTTTTCTATTGTTTTTAG-3'    (SEQ ID NO: 969)
                      5'-AGUUGAUUUUUUUCUAUUGUUUUUAGA-3'    (SEQ ID NO: 2278)
                      3'-UCAACUAAAAAAAGAUAACAAAAAUCU-5'    (SEQ ID NO: 643)
MYC-2322  Target:     5'-AGTTGATTTTTTTCTATTGTTTTTAGA-3'    (SEQ ID NO: 970)
                      5'-GUUGAUUUUUUUCUAUUGUUUUUAGAA-3'    (SEQ ID NO: 2279)
                      3'-CAACUAAAAAAAGAUAACAAAAAUCUU-5'    (SEQ ID NO: 644)
MYC-2323  Target:     5'-GTTGATTTTTTTCTATTGTTTTTAGAA-3'    (SEQ ID NO: 971)
                      5'-UUGAUUUUUUUCUAUUGUUUUUAGAAA-3'    (SEQ ID NO: 2280)
                      3'-AACUAAAAAAAGAUAACAAAAAUCUUU-5'    (SEQ ID NO: 645)
MYC-2324  Target:     5'-TTGATTTTTTTCTATTGTTTTTAGAAA-3'    (SEQ ID NO: 972)
                      5'-UGAUUUUUUUCUAUUGUUUUUAGAAAA-3'    (SEQ ID NO: 2281)
                      3'-ACUAAAAAAAGAUAACAAAAAUCUUUU-5'    (SEQ ID NO: 646)
MYC-2325  Target:     5'-TGATTTTTTTCTATTGTTTTTAGAAAA-3'    (SEQ ID NO: 973)
```

TABLE 7-continued

Selected Human Anti-MYC "Blunt/Blunt" DsiRNAs

|  |  |
|---|---|
| 5'-GAUUUUUUCUAUUGUUUUUAGAAAAA-3' | (SEQ ID NO: 2282) |
| 3'-CUAAAAAAGAUAACAAAAAUCUUUUU-5' | (SEQ ID NO: 647) |
| MYC-2326 Target: 5'-GATTTTTTCTATTGTTTTTAGAAAAA-3' | (SEQ ID NO: 974) |
| 5'-AUUUUUUCUAUUGUUUUUAGAAAAAU-3' | (SEQ ID NO: 2283) |
| 3'-UAAAAAAAGAUAACAAAAAUCUUUUUU-5' | (SEQ ID NO: 648) |
| MYC-2327 Target: 5'-ATTTTTTTCTATTGTTTTTAGAAAAAA-3' | (SEQ ID NO: 975) |
| 5'-UUUUUUUCUAUUGUUUUUAGAAAAAAU-3' | (SEQ ID NO: 2284) |
| 3'-AAAAAAAGAUAACAAAAAUCUUUUUUA-5' | (SEQ ID NO: 649) |
| MYC-2328 Target: 5'-TTTTTTTCTATTGTTTTTAGAAAAAAT-3' | (SEQ ID NO: 976) |
| 5'-UUUUUUCUAUUGUUUUUAGAAAAAAUA-3' | (SEQ ID NO: 2285) |
| 3'-AAAAAAGAUAACAAAAAUCUUUUUUAU-5' | (SEQ ID NO: 650) |
| MYC-2329 Target: 5'-TTTTTTCTATTGTTTTTAGAAAAAATA-3' | (SEQ ID NO: 977) |
| 5'-UUUUUCUAUUGUUUUUAGAAAAAAUAA-3' | (SEQ ID NO: 2286) |
| 3'-AAAAAGAUAACAAAAAUCUUUUUUAUU-5' | (SEQ ID NO: 651) |
| MYC-2330 Target: 5'-TTTTTCTATTGTTTTTAGAAAAAATAA-3' | (SEQ ID NO: 978) |
| 5'-UUUUCUAUUGUUUUUAGAAAAAAUAAA-3' | (SEQ ID NO: 2287) |
| 3'-AAAAGAUAACAAAAAUCUUUUUUAUUU-5' | (SEQ ID NO: 652) |
| MYC-2331 Target: 5'-TTTTCTATTGTTTTTAGAAAAAATAAA-3' | (SEQ ID NO: 979) |
| 5'-UUUCUAUUGUUUUUAGAAAAAAUAAAA-3' | (SEQ ID NO: 2288) |
| 3'-AAAGAUAACAAAAAUCUUUUUUAUUUU-5' | (SEQ ID NO: 653) |
| MYC-2332 Target: 5'-TTTCTATTGTTTTTAGAAAAAATAAAA-3' | (SEQ ID NO: 980) |
| 5'-UUCUAUUGUUUUUAGAAAAAAUAAAAU-3' | (SEQ ID NO: 2289) |
| 3'-AAGAUAACAAAAAUCUUUUUUAUUUUA-5' | (SEQ ID NO: 654) |
| MYC-2333 Target: 5'-TTCTATTGTTTTTAGAAAAAATAAAAT-3' | (SEQ ID NO: 981) |

TABLE 8

DsiRNA Component 19 Nucleotide Target Sequences In MYC mRNA

| | |
|---|---|
| MYC-94 19 nt Target #1: | 5'-CGAGAAGGGCAGGGCUUCU-3'(SEQ ID NO: 2290) |
| MYC-94 19 nt Target #2: | 5'-UCGAGAAGGGCAGGGCUUC-3'(SEQ ID NO: 2617) |
| MYC-94 19 nt Target #3: | 5'-CUCGAGAAGGGCAGGGCUU-3'(SEQ ID NO: 2944) |
| MYC-178 19 nt Target #1: | 5'-GCUUUAUCUAACUCGCUGU-3'(SEQ ID NO: 2291) |
| MYC-178 19 nt Target #2: | 5'-GGCUUUAUCUAACUCGCUG-3'(SEQ ID NO: 2618) |
| MYC-178 19 nt Target #3: | 5'-GGGCUUUAUCUAACUCGCU-3'(SEQ ID NO: 2945) |
| MYC-365 19 nt Target #1: | 5'-CCCUUGCCGCAUCCACGAA-3'(SEQ ID NO: 2292) |
| MYC-365 19 nt Target #2: | 5'-ACCCUUGCCGCAUCCACGA-3'(SEQ ID NO: 2619) |

TABLE 8-continued

DsiRNA Component 19 Nucleotide Target Sequences In MYC mRNA

MYC-365 19 nt Target #3: 5'-AACCCUUGCCGCAUCCACG-3'(SEQ ID NO: 2946)

MYC-370 19 nt Target #1: 5'-GCCGCAUCCACGAAACUUU-3'(SEQ ID NO: 2293)

MYC-370 19 nt Target #2: 5'-UGCCGCAUCCACGAAACUU-3'(SEQ ID NO: 2620)

MYC-370 19 nt Target #3: 5'-UUGCCGCAUCCACGAAACU-3'(SEQ ID NO: 2947)

MYC-376 19 nt Target #1: 5'-UCCACGAAACUUUGCCCAU-3'(SEQ ID NO: 2294)

MYC-376 19 nt Target #2: 5'-AUCCACGAAACUUUGCCCA-3'(SEQ ID NO: 2621)

MYC-376 19 nt Target #3: 5'-CAUCCACGAAACUUUGCCC-3'(SEQ ID NO: 2948)

MYC-403 19 nt Target #1: 5'-GCGGGCACUUUGCACUGGA-3'(SEQ ID NO: 2295)

MYC-403 19 nt Target #2: 5'-GGCGGGCACUUUGCACUGG-3'(SEQ ID NO: 2622)

MYC-403 19 nt Target #3: 5'-GGGCGGGCACUUUGCACUG-3'(SEQ ID NO: 2949)

MYC-409 19 nt Target #1: 5'-ACUUUGCACUGGAACUUAC-3'(SEQ ID NO: 2296)

MYC-409 19 nt Target #2: 5'-CACUUUGCACUGGAACUUA-3'(SEQ ID NO: 2623)

MYC-409 19 nt Target #3: 5'-GCACUUUGCACUGGAACUU-3'(SEQ ID NO: 2950)

MYC-417 19 nt Target #1: 5'-CUGGAACUUACAACACCCG-3'(SEQ ID NO: 2297)

MYC-417 19 nt Target #2: 5'-ACUGGAACUUACAACACCC-3'(SEQ ID NO: 2624)

MYC-417 19 nt Target #3: 5'-CACUGGAACUUACAACACC-3'(SEQ ID NO: 2951)

MYC-535 19 nt Target #1: 5'-GCAGCUGCUUAGACGCUGG-3'(SEQ ID NO: 2298)

MYC-535 19 nt Target #2: 5'-UGCAGCUGCUUAGACGCUG-3'(SEQ ID NO: 2625)

MYC-535 19 nt Target #3: 5'-UUGCAGCUGCUUAGACGCU-3'(SEQ ID NO: 2952)

MYC-541 19 nt Target #1: 5'-GCUUAGACGCUGGAUUUUU-3'(SEQ ID NO: 2299)

MYC-541 19 nt Target #2: 5'-UGCUUAGACGCUGGAUUUU-3'(SEQ ID NO: 2626)

MYC-541 19 nt Target #3: 5'-CUGCUUAGACGCUGGAUUU-3'(SEQ ID NO: 2953)

MYC-548 19 nt Target #1: 5'-CGCUGGAUUUUUUCGGGU-3'(SEQ ID NO: 2300)

MYC-548 19 nt Target #2: 5'-ACGCUGGAUUUUUUCGGG-3'(SEQ ID NO: 2627)

MYC-548 19 nt Target #3: 5'-GACGCUGGAUUUUUUCGG-3'(SEQ ID NO: 2954)

MYC-553 19 nt Target #1: 5'-GAUUUUUUCGGGUAGUGG-3'(SEQ ID NO: 2301)

MYC-553 19 nt Target #2: 5'-GGAUUUUUUCGGGUAGUG-3'(SEQ ID NO: 2628)

TABLE 8-continued

DsiRNA Component 19 Nucleotide Target Sequences In MYC mRNA

MYC-553 19 nt Target #3: 5'-UGGAUUUUUUCGGGUAGU-3'(SEQ ID NO: 2955)

MYC-562 19 nt Target #1: 5'-CGGGUAGUGGAAAACCAGC-3'(SEQ ID NO: 2302)

MYC-562 19 nt Target #2: 5'-UCGGGUAGUGGAAAACCAG-3'(SEQ ID NO: 2629)

MYC-562 19 nt Target #3: 5'-UUCGGGUAGUGGAAAACCA-3'(SEQ ID NO: 2956)

MYC-601 19 nt Target #1: 5'-CUCAACGUUAGCUUCACCA-3'(SEQ ID NO: 2303)

MYC-601 19 nt Target #2: 5'-CCUCAACGUUAGCUUCACC-3'(SEQ ID NO: 2630)

MYC-601 19 nt Target #3: 5'-CCCUCAACGUUAGCUUCAC-3'(SEQ ID NO: 2957)

MYC-607 19 nt Target #1: 5'-GUUAGCUUCACCAACAGGA-3'(SEQ ID NO: 2304)

MYC-607 19 nt Target #2: 5'-CGUUAGCUUCACCAACAGG-3'(SEQ ID NO: 2631)

MYC-607 19 nt Target #3: 5'-ACGUUAGCUUCACCAACAG-3'(SEQ ID NO: 2958)

MYC-643 19 nt Target #1: 5'-GACUCGGUGCAGCCGUAUU-3'(SEQ ID NO: 2305)

MYC-643 19 nt Target #2: 5'-CGACUCGGUGCAGCCGUAU-3'(SEQ ID NO: 2632)

MYC-643 19 nt Target #3: 5'-ACGACUCGGUGCAGCCGUA-3'(SEQ ID NO: 2959)

MYC-651 19 nt Target #1: 5'-GCAGCCGUAUUUCUACUGC-3'(SEQ ID NO: 2306)

MYC-651 19 nt Target #2: 5'-UGCAGCCGUAUUUCUACUG-3'(SEQ ID NO: 2633)

MYC-651 19 nt Target #3: 5'-GUGCAGCCGUAUUUCUACU-3'(SEQ ID NO: 2960)

MYC-676 19 nt Target #1: 5'-GAGGAGAACUUCUACCAGC-3'(SEQ ID NO: 2307)

MYC-676 19 nt Target #2: 5'-GGAGGAGAACUUCUACCAG-3'(SEQ ID NO: 2634)

MYC-676 19 nt Target #3: 5'-AGGAGGAGAACUUCUACCA-3'(SEQ ID NO: 2961)

MYC-731 19 nt Target #1: 5'-GCGAGGAUAUCUGGAAGAA-3'(SEQ ID NO: 2308)

MYC-731 19 nt Target #2: 5'-AGCGAGGAUAUCUGGAAGA-3'(SEQ ID NO: 2635)

MYC-731 19 nt Target #3: 5'-CAGCGAGGAUAUCUGGAAG-3'(SEQ ID NO: 2962)

MYC-816 19 nt Target #1: 5'-CGUUGCGGUCACACCCUUC-3'(SEQ ID NO: 2309)

MYC-816 19 nt Target #2: 5'-ACGUUGCGGUCACACCCUU-3'(SEQ ID NO: 2636)

MYC-816 19 nt Target #3: 5'-UACGUUGCGGUCACACCCU-3'(SEQ ID NO: 2963)

MYC-920 19 nt Target #1: 5'-ACAUGGUGAACCAGAGUUU-3'(SEQ ID NO: 2310)

MYC-920 19 nt Target #2: 5'-GACAUGGUGAACCAGAGUU-3'(SEQ ID NO: 2637)

TABLE 8-continued

DsiRNA Component 19 Nucleotide Target Sequences In MYC mRNA

MYC-920 19 nt Target #3: 5'-AGACAUGGUGAACCAGAGU-3'(SEQ ID NO: 2964)

MYC-949 19 nt Target #1: 5'-CCGGACGACGAGACCUUCA-3'(SEQ ID NO: 2311)

MYC-949 19 nt Target #2: 5'-CCCGGACGACGAGACCUUC-3'(SEQ ID NO: 2638)

MYC-949 19 nt Target #3: 5'-ACCCGGACGACGAGACCUU-3'(SEQ ID NO: 2965)

MYC-958 19 nt Target #1: 5'-GAGACCUUCAUCAAAAACA-3'(SEQ ID NO: 2312)

MYC-958 19 nt Target #2: 5'-CGAGACCUUCAUCAAAAAC-3'(SEQ ID NO: 2639)

MYC-958 19 nt Target #3: 5'-ACGAGACCUUCAUCAAAAA-3'(SEQ ID NO: 2966)

MYC-970 19 nt Target #1: 5'-AAAAACAUCAUCAUCCAGG-3'(SEQ ID NO: 2313)

MYC-970 19 nt Target #2: 5'-CAAAAACAUCAUCAUCCAG-3'(SEQ ID NO: 2640)

MYC-970 19 nt Target #3: 5'-UCAAAAACAUCAUCAUCCA-3'(SEQ ID NO: 2967)

MYC-987 19 nt Target #1: 5'-GGACUGUAUGUGGAGCGGC-3'(SEQ ID NO: 2314)

MYC-987 19 nt Target #2: 5'-AGGACUGUAUGUGGAGCGG-3'(SEQ ID NO: 2641)

MYC-987 19 nt Target #3: 5'-CAGGACUGUAUGUGGAGCG-3'(SEQ ID NO: 2968)

MYC-1104 19 nt Target #1:5'-CUGCUCCACCUCCAGCUUG-3'(SEQ ID NO: 2315)

MYC-1104 19 nt Target #2:5'-UCUGCUCCACCUCCAGCUU-3'(SEQ ID NO: 2642)

MYC-1104 19 nt Target #3:5'-GUCUGCUCCACCUCCAGCU-3'(SEQ ID NO: 2969)

MYC-1111 19 nt Target #1:5'-ACCUCCAGCUUGUACCUGC-3'(SEQ ID NO: 2316)

MYC-1111 19 nt Target #2:5'-CACCUCCAGCUUGUACCUG-3'(SEQ ID NO: 2643)

MYC-1111 19 nt Target #3:5'-CCACCUCCAGCUUGUACCU-3'(SEQ ID NO: 2970)

MYC-1116 19 nt Target #1:5'-CAGCUUGUACCUGCAGGAU-3'(SEQ ID NO: 2317)

MYC-1116 19 nt Target #2:5'-CCAGCUUGUACCUGCAGGA-3'(SEQ ID NO: 2644)

MYC-1116 19 nt Target #3:5'-UCCAGCUUGUACCUGCAGG-3'(SEQ ID NO: 2971)

MYC-1210 19 nt Target #1:5'-AAGUCCUGCGCCUCGCAAG-3'(SEQ ID NO: 2318)

MYC-1210 19 nt Target #2:5'-CAAGUCCUGCGCCUCGCAA-3'(SEQ ID NO: 2645)

MYC-1210 19 nt Target #3:5'-CCAAGUCCUGCGCCUCGCA-3'(SEQ ID NO: 2972)

MYC-1340 19 nt Target #1:5'-GCAGCGACUCUGAGGAGGA-3'(SEQ ID NO: 2319)

MYC-1340 19 nt Target #2:5'-AGCAGCGACUCUGAGGAGG-3'(SEQ ID NO: 2646)

TABLE 8-continued

DsiRNA Component 19 Nucleotide Target Sequences In MYC mRNA

MYC-1340 19 nt Target #3:5'-CAGCAGCGACUCUGAGGAG-3'(SEQ ID NO: 2973)

MYC-1346 19 nt Target #1:5'-ACUCUGAGGAGGAACAAGA-3'(SEQ ID NO: 2320)

MYC-1346 19 nt Target #2:5'-GACUCUGAGGAGGAACAAG-3'(SEQ ID NO: 2647)

MYC-1346 19 nt Target #3:5'-CGACUCUGAGGAGGAACAA-3'(SEQ ID NO: 2974)

MYC-1351 19 nt Target #1:5'-GAGGAGGAACAAGAAGAUG-3'(SEQ ID NO: 2321)

MYC-1351 19 nt Target #2:5'-UGAGGAGGAACAAGAAGAU-3'(SEQ ID NO: 2648)

MYC-1351 19 nt Target #3:5'-CUGAGGAGGAACAAGAAGA-3'(SEQ ID NO: 2975)

MYC-1358 19 nt Target #1:5'-AACAAGAAGAUGAGGAAGA-3'(SEQ ID NO: 2322)

MYC-1358 19 nt Target #2:5'-GAACAAGAAGAUGAGGAAG-3'(SEQ ID NO: 2649)

MYC-1358 19 nt Target #3:5'-GGAACAAGAAGAUGAGGAA-3'(SEQ ID NO: 2976)

MYC-1364 19 nt Target #1:5'-AAGAUGAGGAAGAAAUCGA-3'(SEQ ID NO: 2323)

MYC-1364 19 nt Target #2:5'-GAAGAUGAGGAAGAAAUCG-3'(SEQ ID NO: 2650)

MYC-1364 19 nt Target #3:5'-AGAAGAUGAGGAAGAAAUC-3'(SEQ ID NO: 2977)

MYC-1370 19 nt Target #1:5'-AGGAAGAAAUCGAUGUUGU-3'(SEQ ID NO: 2324)

MYC-1370 19 nt Target #2:5'-GAGGAAGAAAUCGAUGUUG-3'(SEQ ID NO: 2651)

MYC-1370 19 nt Target #3:5'-UGAGGAAGAAAUCGAUGUU-3'(SEQ ID NO: 2978)

MYC-1376 19 nt Target #1:5'-AAAUCGAUGUUGUUUCUGU-3'(SEQ ID NO: 2325)

MYC-1376 19 nt Target #2:5'-GAAAUCGAUGUUGUUUCUG-3'(SEQ ID NO: 2652)

MYC-1376 19 nt Target #3:5'-AGAAAUCGAUGUUGUUUCU-3'(SEQ ID NO: 2979)

MYC-1382 19 nt Target #1:5'-AUGUUGUUUCUGUGGAAAA-3'(SEQ ID NO: 2326)

MYC-1382 19 nt Target #2:5'-GAUGUUGUUUCUGUGGAAA-3'(SEQ ID NO: 2653)

MYC-1382 19 nt Target #3:5'-CGAUGUUGUUUCUGUGGAA-3'(SEQ ID NO: 2980)

MYC-1401 19 nt Target #1:5'-GAGGCAGGCUCCUGGCAAA-3'(SEQ ID NO: 2327)

MYC-1401 19 nt Target #2:5'-AGAGGCAGGCUCCUGGCAA-3'(SEQ ID NO: 2654)

MYC-1401 19 nt Target #3:5'-AAGAGGCAGGCUCCUGGCA-3'(SEQ ID NO: 2981)

MYC-1406 19 nt Target #1:5'-AGGCUCCUGGCAAAAGGUC-3'(SEQ ID NO: 2328)

MYC-1406 19 nt Target #2:5'-CAGGCUCCUGGCAAAAGGU-3'(SEQ ID NO: 2655)

TABLE 8-continued

DsiRNA Component 19 Nucleotide Target Sequences In MYC mRNA

MYC-1406 19 nt Target #3:5'-GCAGGCUCCUGGCAAAAGG-3'(SEQ ID NO: 2982)

MYC-1411 19 nt Target #1:5'-CCUGGCAAAAGGUCAGAGU-3'(SEQ ID NO: 2329)

MYC-1411 19 nt Target #2:5'-UCCUGGCAAAAGGUCAGAG-3'(SEQ ID NO: 2656)

MYC-1411 19 nt Target #3:5'-CUCCUGGCAAAAGGUCAGA-3'(SEQ ID NO: 2983)

MYC-1416 19 nt Target #1:5'-CAAAAGGUCAGAGUCUGGA-3'(SEQ ID NO: 2330)

MYC-1416 19 nt Target #2:5'-GCAAAAGGUCAGAGUCUGG-3'(SEQ ID NO: 2657)

MYC-1416 19 nt Target #3:5'-GGCAAAAGGUCAGAGUCUG-3'(SEQ ID NO: 2984)

MYC-1421 19 nt Target #1:5'-GGUCAGAGUCUGGAUCACC-3'(SEQ ID NO: 2331)

MYC-1421 19 nt Target #2:5'-AGGUCAGAGUCUGGAUCAC-3'(SEQ ID NO: 2658)

MYC-1421 19 nt Target #3:5'-AAGGUCAGAGUCUGGAUCA-3'(SEQ ID NO: 2985)

MYC-1457 19 nt Target #1:5'-GCAAACCUCCUCACAGCCC-3'(SEQ ID NO: 2332)

MYC-1457 19 nt Target #2:5'-AGCAAACCUCCUCACAGCC-3'(SEQ ID NO: 2659)

MYC-1457 19 nt Target #3:5'-CAGCAAACCUCCUCACAGC-3'(SEQ ID NO: 2986)

MYC-1465 19 nt Target #1:5'-CCUCACAGCCCACUGGUCC-3'(SEQ ID NO: 2333)

MYC-1465 19 nt Target #2:5'-UCCUCACAGCCCACUGGUC-3'(SEQ ID NO: 2660)

MYC-1465 19 nt Target #3:5'-CUCCUCACAGCCCACUGGU-3'(SEQ ID NO: 2987)

MYC-1531 19 nt Target #1:5'-CCCUCCACUCGGAAGGACU-3'(SEQ ID NO: 2334)

MYC-1531 19 nt Target #2:5'-UCCCUCCACUCGGAAGGAC-3'(SEQ ID NO: 2661)

MYC-1531 19 nt Target #3:5'-CUCCCUCCACUCGGAAGGA-3'(SEQ ID NO: 2988)

MYC-1538 19 nt Target #1:5'-CUCGGAAGGACUAUCCUGC-3'(SEQ ID NO: 2335)

MYC-1538 19 nt Target #2:5'-ACUCGGAAGGACUAUCCUG-3'(SEQ ID NO: 2662)

MYC-1538 19 nt Target #3:5'-CACUCGGAAGGACUAUCCU-3'(SEQ ID NO: 2989)

MYC-1550 19 nt Target #1:5'-AUCCUGCUGCCAAGAGGGU-3'(SEQ ID NO: 2336)

MYC-1550 19 nt Target #2:5'-UAUCCUGCUGCCAAGAGGG-3'(SEQ ID NO: 2663)

MYC-1550 19 nt Target #3:5'-CUAUCCUGCUGCCAAGAGG-3'(SEQ ID NO: 2990)

MYC-1555 19 nt Target #1:5'-GCUGCCAAGAGGGUCAAGU-3'(SEQ ID NO: 2337)

MYC-1555 19 nt Target #2:5'-UGCUGCCAAGAGGGUCAAG-3'(SEQ ID NO: 2664)

TABLE 8-continued

DsiRNA Component 19 Nucleotide Target Sequences In MYC mRNA

MYC-1555 19 nt Target #3: 5'-CUGCUGCCAAGAGGGUCAA-3' (SEQ ID NO: 2991)

MYC-1560 19 nt Target #1: 5'-CAAGAGGGUCAAGUUGGAC-3' (SEQ ID NO: 2338)

MYC-1560 19 nt Target #2: 5'-CCAAGAGGGUCAAGUUGGA-3' (SEQ ID NO: 2665)

MYC-1560 19 nt Target #3: 5'-GCCAAGAGGGUCAAGUUGG-3' (SEQ ID NO: 2992)

MYC-1565 19 nt Target #1: 5'-GGGUCAAGUUGGACAGUGU-3' (SEQ ID NO: 2339)

MYC-1565 19 nt Target #2: 5'-AGGGUCAAGUUGGACAGUG-3' (SEQ ID NO: 2666)

MYC-1565 19 nt Target #3: 5'-GAGGGUCAAGUUGGACAGU-3' (SEQ ID NO: 2993)

MYC-1570 19 nt Target #1: 5'-AAGUUGGACAGUGUCAGAG-3' (SEQ ID NO: 2340)

MYC-1570 19 nt Target #2: 5'-CAAGUUGGACAGUGUCAGA-3' (SEQ ID NO: 2667)

MYC-1570 19 nt Target #3: 5'-UCAAGUUGGACAGUGUCAG-3' (SEQ ID NO: 2994)

MYC-1575 19 nt Target #1: 5'-GGACAGUGUCAGAGUCCUG-3' (SEQ ID NO: 2341)

MYC-1575 19 nt Target #2: 5'-UGGACAGUGUCAGAGUCCU-3' (SEQ ID NO: 2668)

MYC-1575 19 nt Target #3: 5'-UUGGACAGUGUCAGAGUCC-3' (SEQ ID NO: 2995)

MYC-1584 19 nt Target #1: 5'-CAGAGUCCUGAGACAGAUC-3' (SEQ ID NO: 2342)

MYC-1584 19 nt Target #2: 5'-UCAGAGUCCUGAGACAGAU-3' (SEQ ID NO: 2669)

MYC-1584 19 nt Target #3: 5'-GUCAGAGUCCUGAGACAGA-3' (SEQ ID NO: 2996)

MYC-1593 19 nt Target #1: 5'-GAGACAGAUCAGCAACAAC-3' (SEQ ID NO: 2343)

MYC-1593 19 nt Target #2: 5'-UGAGACAGAUCAGCAACAA-3' (SEQ ID NO: 2670)

MYC-1593 19 nt Target #3: 5'-CUGAGACAGAUCAGCAACA-3' (SEQ ID NO: 2997)

MYC-1599 19 nt Target #1: 5'-GAUCAGCAACAACCGAAAA-3' (SEQ ID NO: 2344)

MYC-1599 19 nt Target #2: 5'-AGAUCAGCAACAACCGAAA-3' (SEQ ID NO: 2671)

MYC-1599 19 nt Target #3: 5'-CAGAUCAGCAACAACCGAA-3' (SEQ ID NO: 2998)

MYC-1634 19 nt Target #1: 5'-CCUCGGACACCGAGGAGAA-3' (SEQ ID NO: 2345)

MYC-1634 19 nt Target #2: 5'-UCCUCGGACACCGAGGAGA-3' (SEQ ID NO: 2672)

MYC-1634 19 nt Target #3: 5'-GUCCUCGGACACCGAGGAG-3' (SEQ ID NO: 2999)

MYC-1639 19 nt Target #1: 5'-GACACCGAGGAGAAUGUCA-3' (SEQ ID NO: 2346)

MYC-1639 19 nt Target #2: 5'-GGACACCGAGGAGAAUGUC-3' (SEQ ID NO: 2673)

TABLE 8-continued

DsiRNA Component 19 Nucleotide Target Sequences In MYC mRNA

MYC-1639 19 nt Target #3: 5'-CGGACACCGAGGAGAAUGU-3' (SEQ ID NO: 3000)

MYC-1687 19 nt Target #1: 5'-CAGAGGAGGAACGAGCUAA-3' (SEQ ID NO: 2347)

MYC-1687 19 nt Target #2: 5'-CCAGAGGAGGAACGAGCUA-3' (SEQ ID NO: 2674)

MYC-1687 19 nt Target #3: 5'-GCCAGAGGAGGAACGAGCU-3' (SEQ ID NO: 3001)

MYC-1693 19 nt Target #1: 5'-AGGAACGAGCUAAAACGGA-3' (SEQ ID NO: 2348)

MYC-1693 19 nt Target #2: 5'-GAGGAACGAGCUAAAACGG-3' (SEQ ID NO: 2675)

MYC-1693 19 nt Target #3: 5'-GGAGGAACGAGCUAAAACG-3' (SEQ ID NO: 3002)

MYC-1698 19 nt Target #1: 5'-CGAGCUAAAACGGAGCUUU-3' (SEQ ID NO: 2349)

MYC-1698 19 nt Target #2: 5'-ACGAGCUAAAACGGAGCUU-3' (SEQ ID NO: 2676)

MYC-1698 19 nt Target #3: 5'-AACGAGCUAAAACGGAGCU-3' (SEQ ID NO: 3003)

MYC-1704 19 nt Target #1: 5'-AAAACGGAGCUUUUUGCC-3' (SEQ ID NO: 2350)

MYC-1704 19 nt Target #2: 5'-UAAAACGGAGCUUUUUGC-3' (SEQ ID NO: 2677)

MYC-1704 19 nt Target #3: 5'-CUAAAACGGAGCUUUUUG-3' (SEQ ID NO: 3004)

MYC-1709 19 nt Target #1: 5'-GGAGCUUUUUGCCCUGCG-3' (SEQ ID NO: 2351)

MYC-1709 19 nt Target #2: 5'-CGGAGCUUUUUGCCCUGC-3' (SEQ ID NO: 2678)

MYC-1709 19 nt Target #3: 5'-ACGGAGCUUUUUGCCCUG-3' (SEQ ID NO: 3005)

MYC-1729 19 nt Target #1: 5'-GACCAGAUCCCGGAGUUGG-3' (SEQ ID NO: 2352)

MYC-1729 19 nt Target #2: 5'-UGACCAGAUCCCGGAGUUG-3' (SEQ ID NO: 2679)

MYC-1729 19 nt Target #3: 5'-GUGACCAGAUCCCGGAGUU-3' (SEQ ID NO: 3006)

MYC-1734 19 nt Target #1: 5'-GAUCCCGGAGUUGGAAAAC-3' (SEQ ID NO: 2353)

MYC-1734 19 nt Target #2: 5'-AGAUCCCGGAGUUGGAAAA-3' (SEQ ID NO: 2680)

MYC-1734 19 nt Target #3: 5'-CAGAUCCCGGAGUUGGAAA-3' (SEQ ID NO: 3007)

MYC-1739 19 nt Target #1: 5'-CGGAGUUGGAAAACAAUGA-3' (SEQ ID NO: 2354)

MYC-1739 19 nt Target #2: 5'-CCGGAGUUGGAAAACAAUG-3' (SEQ ID NO: 2681)

MYC-1739 19 nt Target #3: 5'-CCCGGAGUUGGAAAACAAU-3' (SEQ ID NO: 3008)

MYC-1769 19 nt Target #1: 5'-AGGUAGUUAUCCUUAAAAA-3' (SEQ ID NO: 2355)

MYC-1769 19 nt Target #2: 5'-AAGGUAGUUAUCCUUAAAA-3' (SEQ ID NO: 2682)

TABLE 8-continued

DsiRNA Component 19 Nucleotide Target Sequences In MYC mRNA

MYC-1769 19 nt Target #3:5'-CAAGGUAGUUAUCCUUAAA-3'(SEQ ID NO: 3009)

MYC-1774 19 nt Target #1:5'-GUUAUCCUUAAAAAAGCCA-3'(SEQ ID NO: 2356)

MYC-1774 19 nt Target #2:5'-AGUUAUCCUUAAAAAAGCC-3'(SEQ ID NO: 2683)

MYC-1774 19 nt Target #3:5'-UAGUUAUCCUUAAAAAAGC-3'(SEQ ID NO: 3010)

MYC-1779 19 nt Target #1:5'-CCUUAAAAAAGCCACAGCA-3'(SEQ ID NO: 2357)

MYC-1779 19 nt Target #2:5'-UCCUUAAAAAAGCCACAGC-3'(SEQ ID NO: 2684)

MYC-1779 19 nt Target #3:5'-AUCCUUAAAAAAGCCACAG-3'(SEQ ID NO: 3011)

MYC-1784 19 nt Target #1:5'-AAAAAGCCACAGCAUACAU-3'(SEQ ID NO: 2358)

MYC-1784 19 nt Target #2:5'-AAAAAAGCCACAGCAUACA-3'(SEQ ID NO: 2685)

MYC-1784 19 nt Target #3:5'-UAAAAAAGCCACAGCAUAC-3'(SEQ ID NO: 3012)

MYC-1789 19 nt Target #1:5'-GCCACAGCAUACAUCCUGU-3'(SEQ ID NO: 2359)

MYC-1789 19 nt Target #2:5'-AGCCACAGCAUACAUCCUG-3'(SEQ ID NO: 2686)

MYC-1789 19 nt Target #3:5'-AAGCCACAGCAUACAUCCU-3'(SEQ ID NO: 3013)

MYC-1795 19 nt Target #1:5'-GCAUACAUCCUGUCCGUCC-3'(SEQ ID NO: 2360)

MYC-1795 19 nt Target #2:5'-AGCAUACAUCCUGUCCGUC-3'(SEQ ID NO: 2687)

MYC-1795 19 nt Target #3:5'-CAGCAUACAUCCUGUCCGU-3'(SEQ ID NO: 3014)

MYC-1803 19 nt Target #1:5'-CCUGUCCGUCCAAGCAGAG-3'(SEQ ID NO: 2361)

MYC-1803 19 nt Target #2:5'-UCCUGUCCGUCCAAGCAGA-3'(SEQ ID NO: 2688)

MYC-1803 19 nt Target #3:5'-AUCCUGUCCGUCCAAGCAG-3'(SEQ ID NO: 3015)

MYC-1808 19 nt Target #1:5'-CCGUCCAAGCAGAGGAGCA-3'(SEQ ID NO: 2362)

MYC-1808 19 nt Target #2:5'-UCCGUCCAAGCAGAGGAGC-3'(SEQ ID NO: 2689)

MYC-1808 19 nt Target #3:5'-GUCCGUCCAAGCAGAGGAG-3'(SEQ ID NO: 3016)

MYC-1816 19 nt Target #1:5'-GCAGAGGAGCAAAAGCUCA-3'(SEQ ID NO: 2363)

MYC-1816 19 nt Target #2:5'-AGCAGAGGAGCAAAAGCUC-3'(SEQ ID NO: 2690)

MYC-1816 19 nt Target #3:5'-AAGCAGAGGAGCAAAAGCU-3'(SEQ ID NO: 3017)

MYC-1823 19 nt Target #1:5'-AGCAAAAGCUCAUUUCUGA-3'(SEQ ID NO: 2364)

MYC-1823 19 nt Target #2:5'-GAGCAAAAGCUCAUUUCUG-3'(SEQ ID NO: 2691)

TABLE 8-continued

DsiRNA Component 19 Nucleotide Target Sequences In MYC mRNA

MYC-1823 19 nt Target #3: 5'-GGAGCAAAAGCUCAUUUCU-3' (SEQ ID NO: 3018)

MYC-1828 19 nt Target #1: 5'-AAGCUCAUUUCUGAAGAGG-3' (SEQ ID NO: 2365)

MYC-1828 19 nt Target #2: 5'-AAAGCUCAUUUCUGAAGAG-3' (SEQ ID NO: 2692)

MYC-1828 19 nt Target #3: 5'-AAAAGCUCAUUUCUGAAGA-3' (SEQ ID NO: 3019)

MYC-1834 19 nt Target #1: 5'-AUUUCUGAAGAGGACUUGU-3' (SEQ ID NO: 2366)

MYC-1834 19 nt Target #2: 5'-CAUUUCUGAAGAGGACUUG-3' (SEQ ID NO: 2693)

MYC-1834 19 nt Target #3: 5'-UCAUUUCUGAAGAGGACUU-3' (SEQ ID NO: 3020)

MYC-1840 19 nt Target #1: 5'-GAAGAGGACUUGUUGCGGA-3' (SEQ ID NO: 2367)

MYC-1840 19 nt Target #2: 5'-UGAAGAGGACUUGUUGCGG-3' (SEQ ID NO: 2694)

MYC-1840 19 nt Target #3: 5'-CUGAAGAGGACUUGUUGCG-3' (SEQ ID NO: 3021)

MYC-1845 19 nt Target #1: 5'-GGACUUGUUGCGGAAACGA-3' (SEQ ID NO: 2368)

MYC-1845 19 nt Target #2: 5'-AGGACUUGUUGCGGAAACG-3' (SEQ ID NO: 2695)

MYC-1845 19 nt Target #3: 5'-GAGGACUUGUUGCGGAAAC-3' (SEQ ID NO: 3022)

MYC-1850 19 nt Target #1: 5'-UGUUGCGGAAACGACGAGA-3' (SEQ ID NO: 2369)

MYC-1850 19 nt Target #2: 5'-UUGUUGCGGAAACGACGAG-3' (SEQ ID NO: 2696)

MYC-1850 19 nt Target #3: 5'-CUUGUUGCGGAAACGACGA-3' (SEQ ID NO: 3023)

MYC-1855 19 nt Target #1: 5'-CGGAAACGACGAGAACAGU-3' (SEQ ID NO: 2370)

MYC-1855 19 nt Target #2: 5'-GCGGAAACGACGAGAACAG-3' (SEQ ID NO: 2697)

MYC-1855 19 nt Target #3: 5'-UGCGGAAACGACGAGAACA-3' (SEQ ID NO: 3024)

MYC-1882 19 nt Target #1: 5'-AAACUUGAACAGCUACGGA-3' (SEQ ID NO: 2371)

MYC-1882 19 nt Target #2: 5'-CAAACUUGAACAGCUACGG-3' (SEQ ID NO: 2698)

MYC-1882 19 nt Target #3: 5'-ACAAACUUGAACAGCUACG-3' (SEQ ID NO: 3025)

MYC-1888 19 nt Target #1: 5'-GAACAGCUACGGAACUCUU-3' (SEQ ID NO: 2372)

MYC-1888 19 nt Target #2: 5'-UGAACAGCUACGGAACUCU-3' (SEQ ID NO: 2699)

MYC-1888 19 nt Target #3: 5'-UUGAACAGCUACGGAACUC-3' (SEQ ID NO: 3026)

MYC-1893 19 nt Target #1: 5'-GCUACGGAACUCUUGUGCG-3' (SEQ ID NO: 2373)

MYC-1893 19 nt Target #2: 5'-AGCUACGGAACUCUUGUGC-3' (SEQ ID NO: 2700)

TABLE 8-continued

DsiRNA Component 19 Nucleotide Target Sequences In MYC mRNA

MYC-1893 19 nt Target #3:5'-CAGCUACGGAACUCUUGUG-3'(SEQ ID NO: 3027)

MYC-1900 19 nt Target #1:5'-AACUCUUGUGCGUAAGGAA-3'(SEQ ID NO: 2374)

MYC-1900 19 nt Target #2:5'-GAACUCUUGUGCGUAAGGA-3'(SEQ ID NO: 2701)

MYC-1900 19 nt Target #3:5'-GGAACUCUUGUGCGUAAGG-3'(SEQ ID NO: 3028)

MYC-1906 19 nt Target #1:5'-UGUGCGUAAGGAAAAGUAA-3'(SEQ ID NO: 2375)

MYC-1906 19 nt Target #2:5'-UUGUGCGUAAGGAAAAGUA-3'(SEQ ID NO: 2702)

MYC-1906 19 nt Target #3:5'-CUUGUGCGUAAGGAAAAGU-3'(SEQ ID NO: 3029)

MYC-1911 19 nt Target #1:5'-GUAAGGAAAAGUAAGGAAA-3'(SEQ ID NO: 2376)

MYC-1911 19 nt Target #2:5'-CGUAAGGAAAAGUAAGGAA-3'(SEQ ID NO: 2703)

MYC-1911 19 nt Target #3:5'-GCGUAAGGAAAAGUAAGGA-3'(SEQ ID NO: 3030)

MYC-1921 19 nt Target #1:5'-GUAAGGAAAACGAUUCCUU-3'(SEQ ID NO: 2377)

MYC-1921 19 nt Target #2:5'-AGUAAGGAAAACGAUUCCU-3'(SEQ ID NO: 2704)

MYC-1921 19 nt Target #3:5'-AAGUAAGGAAAACGAUUCC-3'(SEQ ID NO: 3031)

MYC-1926 19 nt Target #1:5'-GAAAACGAUUCCUUCUAAC-3'(SEQ ID NO: 2378)

MYC-1926 19 nt Target #2:5'-GGAAAACGAUUCCUUCUAA-3'(SEQ ID NO: 2705)

MYC-1926 19 nt Target #3:5'-AGGAAAACGAUUCCUUCUA-3'(SEQ ID NO: 3032)

MYC-1931 19 nt Target #1:5'-CGAUUCCUUCUAACAGAAA-3'(SEQ ID NO: 2379)

MYC-1931 19 nt Target #2:5'-ACGAUUCCUUCUAACAGAA-3'(SEQ ID NO: 2706)

MYC-1931 19 nt Target #3:5'-AACGAUUCCUUCUAACAGA-3'(SEQ ID NO: 3033)

MYC-1937 19 nt Target #1:5'-CUUCUAACAGAAAUGUCCU-3'(SEQ ID NO: 2380)

MYC-1937 19 nt Target #2:5'-CCUUCUAACAGAAAUGUCC-3'(SEQ ID NO: 2707)

MYC-1937 19 nt Target #3:5'-UCCUUCUAACAGAAAUGUC-3'(SEQ ID NO: 3034)

MYC-1944 19 nt Target #1:5'-CAGAAAUGUCCUGAGCAAU-3'(SEQ ID NO: 2381)

MYC-1944 19 nt Target #2:5'-ACAGAAAUGUCCUGAGCAA-3'(SEQ ID NO: 2708)

MYC-1944 19 nt Target #3:5'-AACAGAAAUGUCCUGAGCA-3'(SEQ ID NO: 3035)

MYC-1953 19 nt Target #1:5'-CCUGAGCAAUCACCUAUGA-3'(SEQ ID NO: 2382)

MYC-1953 19 nt Target #2:5'-UCCUGAGCAAUCACCUAUG-3'(SEQ ID NO: 2709)

TABLE 8-continued

DsiRNA Component 19 Nucleotide Target Sequences In MYC mRNA

MYC-1953 19 nt Target #3:5'-GUCCUGAGCAAUCACCUAU-3'(SEQ ID NO: 3036)

MYC-1959 19 nt Target #1:5'-CAAUCACCUAUGAACUUGU-3'(SEQ ID NO: 2383)

MYC-1959 19 nt Target #2:5'-GCAAUCACCUAUGAACUUG-3'(SEQ ID NO: 2710)

MYC-1959 19 nt Target #3:5'-AGCAAUCACCUAUGAACUU-3'(SEQ ID NO: 3037)

MYC-1965 19 nt Target #1:5'-CCUAUGAACUUGUUUCAAA-3'(SEQ ID NO: 2384)

MYC-1965 19 nt Target #2:5'-ACCUAUGAACUUGUUUCAA-3'(SEQ ID NO: 2711)

MYC-1965 19 nt Target #3:5'-CACCUAUGAACUUGUUUCA-3'(SEQ ID NO: 3038)

MYC-1970 19 nt Target #1:5'-GAACUUGUUUCAAAUGCAU-3'(SEQ ID NO: 2385)

MYC-1970 19 nt Target #2:5'-UGAACUUGUUUCAAAUGCA-3'(SEQ ID NO: 2712)

MYC-1970 19 nt Target #3:5'-AUGAACUUGUUUCAAAUGC-3'(SEQ ID NO: 3039)

MYC-1976 19 nt Target #1:5'-GUUUCAAAUGCAUGAUCAA-3'(SEQ ID NO: 2386)

MYC-1976 19 nt Target #2:5'-UGUUUCAAAUGCAUGAUCA-3'(SEQ ID NO: 2713)

MYC-1976 19 nt Target #3:5'-UUGUUUCAAAUGCAUGAUC-3'(SEQ ID NO: 3040)

MYC-1981 19 nt Target #1:5'-AAAUGCAUGAUCAAAUGCA-3'(SEQ ID NO: 2387)

MYC-1981 19 nt Target #2:5'-CAAAUGCAUGAUCAAAUGC-3'(SEQ ID NO: 2714)

MYC-1981 19 nt Target #3:5'-UCAAAUGCAUGAUCAAAUG-3'(SEQ ID NO: 3041)

MYC-1989 19 nt Target #1:5'-GAUCAAAUGCAACCUCACA-3'(SEQ ID NO: 2388)

MYC-1989 19 nt Target #2:5'-UGAUCAAAUGCAACCUCAC-3'(SEQ ID NO: 2715)

MYC-1989 19 nt Target #3:5'-AUGAUCAAAUGCAACCUCA-3'(SEQ ID NO: 3042)

MYC-1994 19 nt Target #1:5'-AAUGCAACCUCACAACCUU-3'(SEQ ID NO: 2389)

MYC-1994 19 nt Target #2:5'-AAAUGCAACCUCACAACCU-3'(SEQ ID NO: 2716)

MYC-1994 19 nt Target #3:5'-CAAAUGCAACCUCACAACC-3'(SEQ ID NO: 3043)

MYC-2001 19 nt Target #1:5'-CCUCACAACCUUGGCUGAG-3'(SEQ ID NO: 2390)

MYC-2001 19 nt Target #2:5'-ACCUCACAACCUUGGCUGA-3'(SEQ ID NO: 2717)

MYC-2001 19 nt Target #3:5'-AACCUCACAACCUUGGCUG-3'(SEQ ID NO: 3044)

MYC-2006 19 nt Target #1:5'-CAACCUUGGCUGAGUCUUG-3'(SEQ ID NO: 2391)

MYC-2006 19 nt Target #2:5'-ACAACCUUGGCUGAGUCUU-3'(SEQ ID NO: 2718)

TABLE 8-continued

DsiRNA Component 19 Nucleotide Target Sequences In MYC mRNA

MYC-2006 19 nt Target #3:5'-CACAACCUUGGCUGAGUCU-3'(SEQ ID NO: 3045)

MYC-2013 19 nt Target #1:5'-GGCUGAGUCUUGAGACUGA-3'(SEQ ID NO: 2392)

MYC-2013 19 nt Target #2:5'-UGGCUGAGUCUUGAGACUG-3'(SEQ ID NO: 2719)

MYC-2013 19 nt Target #3:5'-UUGGCUGAGUCUUGAGACU-3'(SEQ ID NO: 3046)

MYC-2019 19 nt Target #1:5'-GUCUUGAGACUGAAAGAUU-3'(SEQ ID NO: 2393)

MYC-2019 19 nt Target #2:5'-AGUCUUGAGACUGAAAGAU-3'(SEQ ID NO: 2720)

MYC-2019 19 nt Target #3:5'-GAGUCUUGAGACUGAAAGA-3'(SEQ ID NO: 3047)

MYC-2026 19 nt Target #1:5'-GACUGAAAGAUUUAGCCAU-3'(SEQ ID NO: 2394)

MYC-2026 19 nt Target #2:5'-AGACUGAAAGAUUUAGCCA-3'(SEQ ID NO: 2721)

MYC-2026 19 nt Target #3:5'-GAGACUGAAAGAUUUAGCC-3'(SEQ ID NO: 3048)

MYC-2031 19 nt Target #1:5'-AAAGAUUUAGCCAUAAUGU-3'(SEQ ID NO: 2395)

MYC-2031 19 nt Target #2:5'-GAAAGAUUUAGCCAUAAUG-3'(SEQ ID NO: 2722)

MYC-2031 19 nt Target #3:5'-UGAAAGAUUUAGCCAUAAU-3'(SEQ ID NO: 3049)

MYC-2040 19 nt Target #1:5'-GCCAUAAUGUAAACUGCCU-3'(SEQ ID NO: 2396)

MYC-2040 19 nt Target #2:5'-AGCCAUAAUGUAAACUGCC-3'(SEQ ID NO: 2723)

MYC-2040 19 nt Target #3:5'-UAGCCAUAAUGUAAACUGC-3'(SEQ ID NO: 3050)

MYC-2048 19 nt Target #1:5'-GUAAACUGCCUCAAAUUGG-3'(SEQ ID NO: 2397)

MYC-2048 19 nt Target #2:5'-UGUAAACUGCCUCAAAUUG-3'(SEQ ID NO: 2724)

MYC-2048 19 nt Target #3:5'-AUGUAAACUGCCUCAAAUU-3'(SEQ ID NO: 3051)

MYC-2054 19 nt Target #1:5'-UGCCUCAAAUUGGACUUUG-3'(SEQ ID NO: 2398)

MYC-2054 19 nt Target #2:5'-CUGCCUCAAAUUGGACUUU-3'(SEQ ID NO: 2725)

MYC-2054 19 nt Target #3:5'-ACUGCCUCAAAUUGGACUU-3'(SEQ ID NO: 3052)

MYC-2059 19 nt Target #1:5'-CAAAUUGGACUUUGGGCAU-3'(SEQ ID NO: 2399)

MYC-2059 19 nt Target #2:5'-UCAAAUUGGACUUUGGGCA-3'(SEQ ID NO: 2726)

MYC-2059 19 nt Target #3:5'-CUCAAAUUGGACUUUGGGC-3'(SEQ ID NO: 3053)

MYC-2066 19 nt Target #1:5'-GACUUUGGGCAUAAAAGAA-3'(SEQ ID NO: 2400)

MYC-2066 19 nt Target #2:5'-GGACUUUGGGCAUAAAAGA-3'(SEQ ID NO: 2727)

TABLE 8-continued

DsiRNA Component 19 Nucleotide Target Sequences In MYC mRNA

MYC-2066 19 nt Target #3: 5'-UGGACUUUGGGCAUAAAAG-3' (SEQ ID NO: 3054)

MYC-2073 19 nt Target #1: 5'-GGCAUAAAAGAACUUUUUU-3' (SEQ ID NO: 2401)

MYC-2073 19 nt Target #2: 5'-GGGCAUAAAAGAACUUUUU-3' (SEQ ID NO: 2728)

MYC-2073 19 nt Target #3: 5'-UGGGCAUAAAAGAACUUUU-3' (SEQ ID NO: 3055)

MYC-2078 19 nt Target #1: 5'-AAAAGAACUUUUUUAUGCU-3' (SEQ ID NO: 2402)

MYC-2078 19 nt Target #2: 5'-UAAAAGAACUUUUUUAUGC-3' (SEQ ID NO: 2729)

MYC-2078 19 nt Target #3: 5'-AUAAAAGAACUUUUUUAUG-3' (SEQ ID NO: 3056)

MYC-2083 19 nt Target #1: 5'-AACUUUUUUAUGCUUACCA-3' (SEQ ID NO: 2403)

MYC-2083 19 nt Target #2: 5'-GAACUUUUUUAUGCUUACC-3' (SEQ ID NO: 2730)

MYC-2083 19 nt Target #3: 5'-AGAACUUUUUUAUGCUUAC-3' (SEQ ID NO: 3057)

MYC-2089 19 nt Target #1: 5'-UUUAUGCUUACCAUCUUUU-3' (SEQ ID NO: 2404)

MYC-2089 19 nt Target #2: 5'-UUUUAUGCUUACCAUCUUU-3' (SEQ ID NO: 2731)

MYC-2089 19 nt Target #3: 5'-UUUUUAUGCUUACCAUCUU-3' (SEQ ID NO: 3058)

MYC-2094 19 nt Target #1: 5'-GCUUACCAUCUUUUUUUU-3' (SEQ ID NO: 2405)

MYC-2094 19 nt Target #2: 5'-UGCUUACCAUCUUUUUUU-3' (SEQ ID NO: 2732)

MYC-2094 19 nt Target #3: 5'-AUGCUUACCAUCUUUUUUU-3' (SEQ ID NO: 3059)

MYC-2099 19 nt Target #1: 5'-CCAUCUUUUUUUUUCUUU-3' (SEQ ID NO: 2406)

MYC-2099 19 nt Target #2: 5'-ACCAUCUUUUUUUUUCUU-3' (SEQ ID NO: 2733)

MYC-2099 19 nt Target #3: 5'-UACCAUCUUUUUUUUUCU-3' (SEQ ID NO: 3060)

MYC-2105 19 nt Target #1: 5'-UUUUUUUUUCUUUAACAGA-3' (SEQ ID NO: 2407)

MYC-2105 19 nt Target #2: 5'-UUUUUUUUUUCUUUAACAG-3' (SEQ ID NO: 2734)

MYC-2105 19 nt Target #3: 5'-CUUUUUUUUUUCUUUAACA-3' (SEQ ID NO: 3061)

MYC-2114 19 nt Target #1: 5'-CUUUAACAGAUUUGUAUUU-3' (SEQ ID NO: 2408)

MYC-2114 19 nt Target #2: 5'-UCUUUAACAGAUUUGUAUU-3' (SEQ ID NO: 2735)

MYC-2114 19 nt Target #3: 5'-UUCUUUAACAGAUUUGUAU-3' (SEQ ID NO: 3062)

MYC-2120 19 nt Target #1: 5'-CAGAUUUGUAUUUAAGAAU-3' (SEQ ID NO: 2409)

MYC-2120 19 nt Target #2: 5'-ACAGAUUUGUAUUUAAGAA-3' (SEQ ID NO: 2736)

TABLE 8-continued

DsiRNA Component 19 Nucleotide Target Sequences In MYC mRNA

MYC-2120 19 nt Target #3: 5'-AACAGAUUUGUAUUUAAGA-3' (SEQ ID NO: 3063)

MYC-2128 19 nt Target #1: 5'-UAUUUAAGAAUUGUUUUUA-3' (SEQ ID NO: 2410)

MYC-2128 19 nt Target #2: 5'-GUAUUUAAGAAUUGUUUUU-3' (SEQ ID NO: 2737)

MYC-2128 19 nt Target #3: 5'-UGUAUUUAAGAAUUGUUUU-3' (SEQ ID NO: 3064)

MYC-2135 19 nt Target #1: 5'-GAAUUGUUUUUAAAAAAUU-3' (SEQ ID NO: 2411)

MYC-2135 19 nt Target #2: 5'-AGAAUUGUUUUUAAAAAAU-3' (SEQ ID NO: 2738)

MYC-2135 19 nt Target #3: 5'-AAGAAUUGUUUUUAAAAAA-3' (SEQ ID NO: 3065)

MYC-2167 19 nt Target #1: 5'-AAUGUUUCUCUGUAAAUAU-3' (SEQ ID NO: 2412)

MYC-2167 19 nt Target #2: 5'-CAAUGUUUCUCUGUAAAUA-3' (SEQ ID NO: 2739)

MYC-2167 19 nt Target #3: 5'-ACAAUGUUUCUCUGUAAAU-3' (SEQ ID NO: 3066)

MYC-2176 19 nt Target #1: 5'-CUGUAAAUAUUGCCAUUAA-3' (SEQ ID NO: 2413)

MYC-2176 19 nt Target #2: 5'-UCUGUAAAUAUUGCCAUUA-3' (SEQ ID NO: 2740)

MYC-2176 19 nt Target #3: 5'-CUCUGUAAAUAUUGCCAUU-3' (SEQ ID NO: 3067)

MYC-2181 19 nt Target #1: 5'-AAUAUUGCCAUUAAAUGUA-3' (SEQ ID NO: 2414)

MYC-2181 19 nt Target #2: 5'-AAAUAUUGCCAUUAAAUGU-3' (SEQ ID NO: 2741)

MYC-2181 19 nt Target #3: 5'-UAAAUAUUGCCAUUAAAUG-3' (SEQ ID NO: 3068)

MYC-2188 19 nt Target #1: 5'-CCAUUAAAUGUAAAUAACU-3' (SEQ ID NO: 2415)

MYC-2188 19 nt Target #2: 5'-GCCAUUAAAUGUAAAUAAC-3' (SEQ ID NO: 2742)

MYC-2188 19 nt Target #3: 5'-UGCCAUUAAAUGUAAAUAA-3' (SEQ ID NO: 3069)

MYC-2207 19 nt Target #1: 5'-UUAAUAAAACGUUUAUAGC-3' (SEQ ID NO: 2416)

MYC-2207 19 nt Target #2: 5'-UUUAAUAAAACGUUUAUAG-3' (SEQ ID NO: 2743)

MYC-2207 19 nt Target #3: 5'-CUUUAAUAAAACGUUUAUA-3' (SEQ ID NO: 3070)

MYC-2233 19 nt Target #1: 5'-CAGAAUUUCAAUCCUAGUA-3' (SEQ ID NO: 2417)

MYC-2233 19 nt Target #2: 5'-ACAGAAUUUCAAUCCUAGU-3' (SEQ ID NO: 2744)

MYC-2233 19 nt Target #3: 5'-CACAGAAUUUCAAUCCUAG-3' (SEQ ID NO: 3071)

MYC-2260 19 nt Target #1: 5'-CUAGUAUUAUAGGUACUAU-3' (SEQ ID NO: 2418)

MYC-2260 19 nt Target #2: 5'-CCUAGUAUUAUAGGUACUA-3' (SEQ ID NO: 2745)

TABLE 8-continued

DsiRNA Component 19 Nucleotide Target Sequences In MYC mRNA

MYC-2260 19 nt Target #3: 5'-ACCUAGUAUUAUAGGUACU-3' (SEQ ID NO: 3072)

MYC-2267 19 nt Target #1: 5'-UAUAGGUACUAUAAACCCU-3' (SEQ ID NO: 2419)

MYC-2267 19 nt Target #2: 5'-UUAUAGGUACUAUAAACCC-3' (SEQ ID NO: 2746)

MYC-2267 19 nt Target #3: 5'-AUUAUAGGUACUAUAAACC-3' (SEQ ID NO: 3073)

MYC-2274 19 nt Target #1: 5'-ACUAUAAACCCUAAUUUUU-3' (SEQ ID NO: 2420)

MYC-2274 19 nt Target #2: 5'-UACUAUAAACCCUAAUUUU-3' (SEQ ID NO: 2747)

MYC-2274 19 nt Target #3: 5'-GUACUAUAAACCCUAAUUU-3' (SEQ ID NO: 3074)

MYC-2282 19 nt Target #1: 5'-CCCUAAUUUUUUUAUUUA-3' (SEQ ID NO: 2421)

MYC-2282 19 nt Target #2: 5'-ACCCUAAUUUUUUUAUUU-3' (SEQ ID NO: 2748)

MYC-2282 19 nt Target #3: 5'-AACCCUAAUUUUUUUAUU-3' (SEQ ID NO: 3075)

MYC-2287 19 nt Target #1: 5'-AUUUUUUUAUUUAAGUAC-3' (SEQ ID NO: 2422)

MYC-2287 19 nt Target #2: 5'-AAUUUUUUUAUUUAAGUA-3' (SEQ ID NO: 2749)

MYC-2287 19 nt Target #3: 5'-UAAUUUUUUUAUUUAAGU-3' (SEQ ID NO: 3076)

MYC-2295 19 nt Target #1: 5'-UAUUUAAGUACAUUUUGCU-3' (SEQ ID NO: 2423)

MYC-2295 19 nt Target #2: 5'-UUAUUUAAGUACAUUUUGC-3' (SEQ ID NO: 2750)

MYC-2295 19 nt Target #3: 5'-UUUAUUUAAGUACAUUUUG-3' (SEQ ID NO: 3077)

MYC-2300 19 nt Target #1: 5'-AAGUACAUUUUGCUUUUUA-3' (SEQ ID NO: 2424)

MYC-2300 19 nt Target #2: 5'-UAAGUACAUUUUGCUUUUU-3' (SEQ ID NO: 2751)

MYC-2300 19 nt Target #3: 5'-UUAAGUACAUUUUGCUUUU-3' (SEQ ID NO: 3078)

MYC-2306 19 nt Target #1: 5'-AUUUUGCUUUUUAAAGUUG-3' (SEQ ID NO: 2425)

MYC-2306 19 nt Target #2: 5'-CAUUUUGCUUUUUAAAGUU-3' (SEQ ID NO: 2752)

MYC-2306 19 nt Target #3: 5'-ACAUUUUGCUUUUUAAAGU-3' (SEQ ID NO: 3079)

MYC-2312 19 nt Target #1: 5'-CUUUUUAAAGUUGAUUUUU-3' (SEQ ID NO: 2426)

MYC-2312 19 nt Target #2: 5'-GCUUUUUAAAGUUGAUUUU-3' (SEQ ID NO: 2753)

MYC-2312 19 nt Target #3: 5'-UGCUUUUUAAAGUUGAUUU-3' (SEQ ID NO: 3080)

MYC-2334 19 nt Target #1: 5'-UAUUGUUUUUAGAAAAAAU-3' (SEQ ID NO: 2427)

MYC-2334 19 nt Target #2: 5'-CUAUUGUUUUUAGAAAAAA-3' (SEQ ID NO: 2754)

TABLE 8-continued

DsiRNA Component 19 Nucleotide Target Sequences In MYC mRNA

MYC-2334 19 nt Target #3: 5'-UCUAUUGUUUUUAGAAAAA-3' (SEQ ID NO: 3081)

MYC-2339 19 nt Target #1: 5'-UUUUUAGAAAAAAUAAAAU-3' (SEQ ID NO: 2428)

MYC-2339 19 nt Target #2: 5'-GUUUUUAGAAAAAAUAAAA-3' (SEQ ID NO: 2755)

MYC-2339 19 nt Target #3: 5'-UGUUUUUAGAAAAAAUAAA-3' (SEQ ID NO: 3082)

MYC-2347 19 nt Target #1: 5'-AAAAAUAAAAUAACUGGCA-3' (SEQ ID NO: 2429)

MYC-2347 19 nt Target #2: 5'-AAAAAAUAAAAUAACUGGC-3' (SEQ ID NO: 2756)

MYC-2347 19 nt Target #3: 5'-GAAAAAAUAAAAUAACUGG-3' (SEQ ID NO: 3083)

MYC-2355 19 nt Target #1: 5'-AAUAACUGGCAAAUAUAUC-3' (SEQ ID NO: 2430)

MYC-2355 19 nt Target #2: 5'-AAAUAACUGGCAAAUAUAU-3' (SEQ ID NO: 2757)

MYC-2355 19 nt Target #3: 5'-AAAAUAACUGGCAAAUAUA-3' (SEQ ID NO: 3084)

MYC-2364 19 nt Target #1: 5'-CAAAUAUAUCAUUGAGCCA-3' (SEQ ID NO: 2431)

MYC-2364 19 nt Target #2: 5'-GCAAAUAUAUCAUUGAGCC-3' (SEQ ID NO: 2758)

MYC-2364 19 nt Target #3: 5'-GGCAAAUAUAUCAUUGAGC-3' (SEQ ID NO: 3085)

MYC-2371 19 nt Target #1: 5'-AUCAUUGAGCCAAAUCUUA-3' (SEQ ID NO: 2432)

MYC-2371 19 nt Target #2: 5'-UAUCAUUGAGCCAAAUCUU-3' (SEQ ID NO: 2759)

MYC-2371 19 nt Target #3: 5'-AUAUCAUUGAGCCAAAUCU-3' (SEQ ID NO: 3086)

MYC-2377 19 nt Target #1: 5'-GAGCCAAAUCUUAAAAAAA-3' (SEQ ID NO: 2433)

MYC-2377 19 nt Target #2: 5'-UGAGCCAAAUCUUAAAAAA-3' (SEQ ID NO: 2760)

MYC-2377 19 nt Target #3: 5'-UUGAGCCAAAUCUUAAAAA-3' (SEQ ID NO: 3087)

MYC-188 19 nt Target #1: 5'-ACUCGCUGUAGUAAUUCCA-3' (SEQ ID NO: 2434)

MYC-188 19 nt Target #2: 5'-AACUCGCUGUAGUAAUUCC-3' (SEQ ID NO: 2761)

MYC-188 19 nt Target #3: 5'-UAACUCGCUGUAGUAAUUC-3' (SEQ ID NO: 3088)

MYC-189 19 nt Target #1: 5'-CUCGCUGUAGUAAUUCCAG-3' (SEQ ID NO: 2435)

MYC-189 19 nt Target #2: 5'-ACUCGCUGUAGUAAUUCCA-3' (SEQ ID NO: 2762)

MYC-189 19 nt Target #3: 5'-AACUCGCUGUAGUAAUUCC-3' (SEQ ID NO: 3089)

MYC-190 19 nt Target #1: 5'-UCGCUGUAGUAAUUCCAGC-3' (SEQ ID NO: 2436)

MYC-190 19 nt Target #2: 5'-CUCGCUGUAGUAAUUCCAG-3' (SEQ ID NO: 2763)

TABLE 8-continued

DsiRNA Component 19 Nucleotide Target Sequences In MYC mRNA

MYC-190 19 nt Target #3: 5'-ACUCGCUGUAGUAAUUCCA-3'(SEQ ID NO: 3090)

MYC-191 19 nt Target #1: 5'-CGCUGUAGUAAUUCCAGCG-3'(SEQ ID NO: 2437)

MYC-191 19 nt Target #2: 5'-UCGCUGUAGUAAUUCCAGC-3'(SEQ ID NO: 2764)

MYC-191 19 nt Target #3: 5'-CUCGCUGUAGUAAUUCCAG-3'(SEQ ID NO: 3091)

MYC-192 19 nt Target #1: 5'-GCUGUAGUAAUUCCAGCGA-3'(SEQ ID NO: 2438)

MYC-192 19 nt Target #2: 5'-CGCUGUAGUAAUUCCAGCG-3'(SEQ ID NO: 2765)

MYC-192 19 nt Target #3: 5'-UCGCUGUAGUAAUUCCAGC-3'(SEQ ID NO: 3092)

MYC-193 19 nt Target #1: 5'-CUGUAGUAAUUCCAGCGAG-3'(SEQ ID NO: 2439)

MYC-193 19 nt Target #2: 5'-GCUGUAGUAAUUCCAGCGA-3'(SEQ ID NO: 2766)

MYC-193 19 nt Target #3: 5'-CGCUGUAGUAAUUCCAGCG-3'(SEQ ID NO: 3093)

MYC-194 19 nt Target #1: 5'-UGUAGUAAUUCCAGCGAGA-3'(SEQ ID NO: 2440)

MYC-194 19 nt Target #2: 5'-CUGUAGUAAUUCCAGCGAG-3'(SEQ ID NO: 2767)

MYC-194 19 nt Target #3: 5'-GCUGUAGUAAUUCCAGCGA-3'(SEQ ID NO: 3094)

MYC-195 19 nt Target #1: 5'-GUAGUAAUUCCAGCGAGAG-3'(SEQ ID NO: 2441)

MYC-195 19 nt Target #2: 5'-UGUAGUAAUUCCAGCGAGA-3'(SEQ ID NO: 2768)

MYC-195 19 nt Target #3: 5'-CUGUAGUAAUUCCAGCGAG-3'(SEQ ID NO: 3095)

MYC-612 19 nt Target #1: 5'-CUUCACCAACAGGAACUAU-3'(SEQ ID NO: 2442)

MYC-612 19 nt Target #2: 5'-GCUUCACCAACAGGAACUA-3'(SEQ ID NO: 2769)

MYC-612 19 nt Target #3: 5'-AGCUUCACCAACAGGAACU-3'(SEQ ID NO: 3096)

MYC-613 19 nt Target #1: 5'-UUCACCAACAGGAACUAUG-3'(SEQ ID NO: 2443)

MYC-613 19 nt Target #2: 5'-CUUCACCAACAGGAACUAU-3'(SEQ ID NO: 2770)

MYC-613 19 nt Target #3: 5'-GCUUCACCAACAGGAACUA-3'(SEQ ID NO: 3097)

MYC-614 19 nt Target #1: 5'-UCACCAACAGGAACUAUGA-3'(SEQ ID NO: 2444)

MYC-614 19 nt Target #2: 5'-UUCACCAACAGGAACUAUG-3'(SEQ ID NO: 2771)

MYC-614 19 nt Target #3: 5'-CUUCACCAACAGGAACUAU-3'(SEQ ID NO: 3098)

MYC-615 19 nt Target #1: 5'-CACCAACAGGAACUAUGAC-3'(SEQ ID NO: 2445)

MYC-615 19 nt Target #2: 5'-UCACCAACAGGAACUAUGA-3'(SEQ ID NO: 2772)

TABLE 8-continued

DsiRNA Component 19 Nucleotide Target Sequences In MYC mRNA

MYC-615 19 nt Target #3: 5'-UUCACCAACAGGAACUAUG-3'(SEQ ID NO: 3099)

MYC-616 19 nt Target #1: 5'-ACCAACAGGAACUAUGACC-3'(SEQ ID NO: 2446)

MYC-616 19 nt Target #2: 5'-CACCAACAGGAACUAUGAC-3'(SEQ ID NO: 2773)

MYC-616 19 nt Target #3: 5'-UCACCAACAGGAACUAUGA-3'(SEQ ID NO: 3100)

MYC-617 19 nt Target #1: 5'-CCAACAGGAACUAUGACCU-3'(SEQ ID NO: 2447)

MYC-617 19 nt Target #2: 5'-ACCAACAGGAACUAUGACC-3'(SEQ ID NO: 2774)

MYC-617 19 nt Target #3: 5'-CACCAACAGGAACUAUGAC-3'(SEQ ID NO: 3101)

MYC-618 19 nt Target #1: 5'-CAACAGGAACUAUGACCUC-3'(SEQ ID NO: 2448)

MYC-618 19 nt Target #2: 5'-CCAACAGGAACUAUGACCU-3'(SEQ ID NO: 2775)

MYC-618 19 nt Target #3: 5'-ACCAACAGGAACUAUGACC-3'(SEQ ID NO: 3102)

MYC-619 19 nt Target #1: 5'-AACAGGAACUAUGACCUCG-3'(SEQ ID NO: 2449)

MYC-619 19 nt Target #2: 5'-CAACAGGAACUAUGACCUC-3'(SEQ ID NO: 2776)

MYC-619 19 nt Target #3: 5'-CCAACAGGAACUAUGACCU-3'(SEQ ID NO: 3103)

MYC-620 19 nt Target #1: 5'-ACAGGAACUAUGACCUCGA-3'(SEQ ID NO: 2450)

MYC-620 19 nt Target #2: 5'-AACAGGAACUAUGACCUCG-3'(SEQ ID NO: 2777)

MYC-620 19 nt Target #3: 5'-CAACAGGAACUAUGACCUC-3'(SEQ ID NO: 3104)

MYC-621 19 nt Target #1: 5'-CAGGAACUAUGACCUCGAC-3'(SEQ ID NO: 2451)

MYC-621 19 nt Target #2: 5'-ACAGGAACUAUGACCUCGA-3'(SEQ ID NO: 2778)

MYC-621 19 nt Target #3: 5'-AACAGGAACUAUGACCUCG-3'(SEQ ID NO: 3105)

MYC-622 19 nt Target #1: 5'-AGGAACUAUGACCUCGACU-3'(SEQ ID NO: 2452)

MYC-622 19 nt Target #2: 5'-CAGGAACUAUGACCUCGAC-3'(SEQ ID NO: 2779)

MYC-622 19 nt Target #3: 5'-ACAGGAACUAUGACCUCGA-3'(SEQ ID NO: 3106)

MYC-623 19 nt Target #1: 5'-GGAACUAUGACCUCGACUA-3'(SEQ ID NO: 2453)

MYC-623 19 nt Target #2: 5'-AGGAACUAUGACCUCGACU-3'(SEQ ID NO: 2780)

MYC-623 19 nt Target #3: 5'-CAGGAACUAUGACCUCGAC-3'(SEQ ID NO: 3107)

MYC-624 19 nt Target #1: 5'-GAACUAUGACCUCGACUAC-3'(SEQ ID NO: 2454)

MYC-624 19 nt Target #2: 5'-GGAACUAUGACCUCGACUA-3'(SEQ ID NO: 2781)

TABLE 8-continued

DsiRNA Component 19 Nucleotide Target Sequences In MYC mRNA

MYC-624 19 nt Target #3: 5'-AGGAACUAUGACCUCGACU-3'(SEQ ID NO: 3108)

MYC-625 19 nt Target #1: 5'-AACUAUGACCUCGACUACG-3'(SEQ ID NO: 2455)

MYC-625 19 nt Target #2: 5'-GAACUAUGACCUCGACUAC-3'(SEQ ID NO: 2782)

MYC-625 19 nt Target #3: 5'-GGAACUAUGACCUCGACUA-3'(SEQ ID NO: 3109)

MYC-626 19 nt Target #1: 5'-ACUAUGACCUCGACUACGA-3'(SEQ ID NO: 2456)

MYC-626 19 nt Target #2: 5'-AACUAUGACCUCGACUACG-3'(SEQ ID NO: 2783)

MYC-626 19 nt Target #3: 5'-GAACUAUGACCUCGACUAC-3'(SEQ ID NO: 3110)

MYC-627 19 nt Target #1: 5'-CUAUGACCUCGACUACGAC-3'(SEQ ID NO: 2457)

MYC-627 19 nt Target #2: 5'-ACUAUGACCUCGACUACGA-3'(SEQ ID NO: 2784)

MYC-627 19 nt Target #3: 5'-AACUAUGACCUCGACUACG-3'(SEQ ID NO: 3111)

MYC-628 19 nt Target #1: 5'-UAUGACCUCGACUACGACU-3'(SEQ ID NO: 2458)

MYC-628 19 nt Target #2: 5'-CUAUGACCUCGACUACGAC-3'(SEQ ID NO: 2785)

MYC-628 19 nt Target #3: 5'-ACUAUGACCUCGACUACGA-3'(SEQ ID NO: 3112)

MYC-629 19 nt Target #1: 5'-AUGACCUCGACUACGACUC-3'(SEQ ID NO: 2459)

MYC-629 19 nt Target #2: 5'-UAUGACCUCGACUACGACU-3'(SEQ ID NO: 2786)

MYC-629 19 nt Target #3: 5'-CUAUGACCUCGACUACGAC-3'(SEQ ID NO: 3113)

MYC-733 19 nt Target #1: 5'-GAGGAUAUCUGGAAGAAAU-3'(SEQ ID NO: 2460)

MYC-733 19 nt Target #2: 5'-CGAGGAUAUCUGGAAGAAA-3'(SEQ ID NO: 2787)

MYC-733 19 nt Target #3: 5'-GCGAGGAUAUCUGGAAGAA-3'(SEQ ID NO: 3114)

MYC-734 19 nt Target #1: 5'-AGGAUAUCUGGAAGAAAUU-3'(SEQ ID NO: 2461)

MYC-734 19 nt Target #2: 5'-GAGGAUAUCUGGAAGAAAU-3'(SEQ ID NO: 2788)

MYC-734 19 nt Target #3: 5'-CGAGGAUAUCUGGAAGAAA-3'(SEQ ID NO: 3115)

MYC-735 19 nt Target #1: 5'-GGAUAUCUGGAAGAAAUUC-3'(SEQ ID NO: 2462)

MYC-735 19 nt Target #2: 5'-AGGAUAUCUGGAAGAAAUU-3'(SEQ ID NO: 2789)

MYC-735 19 nt Target #3: 5'-GAGGAUAUCUGGAAGAAAU-3'(SEQ ID NO: 3116)

MYC-736 19 nt Target #1: 5'-GAUAUCUGGAAGAAAUUCG-3'(SEQ ID NO: 2463)

MYC-736 19 nt Target #2: 5'-GGAUAUCUGGAAGAAAUUC-3'(SEQ ID NO: 2790)

TABLE 8-continued

DsiRNA Component 19 Nucleotide Target Sequences In MYC mRNA

MYC-736 19 nt Target #3: 5'-AGGAUAUCUGGAAGAAAUU-3' (SEQ ID NO: 3117)

MYC-737 19 nt Target #1: 5'-AUAUCUGGAAGAAAUUCGA-3' (SEQ ID NO: 2464)

MYC-737 19 nt Target #2: 5'-GAUAUCUGGAAGAAAUUCG-3' (SEQ ID NO: 2791)

MYC-737 19 nt Target #3: 5'-GGAUAUCUGGAAGAAAUUC-3' (SEQ ID NO: 3118)

MYC-738 19 nt Target #1: 5'-UAUCUGGAAGAAAUUCGAG-3' (SEQ ID NO: 2465)

MYC-738 19 nt Target #2: 5'-AUAUCUGGAAGAAAUUCGA-3' (SEQ ID NO: 2792)

MYC-738 19 nt Target #3: 5'-GAUAUCUGGAAGAAAUUCG-3' (SEQ ID NO: 3119)

MYC-739 19 nt Target #1: 5'-AUCUGGAAGAAAUUCGAGC-3' (SEQ ID NO: 2466)

MYC-739 19 nt Target #2: 5'-UAUCUGGAAGAAAUUCGAG-3' (SEQ ID NO: 2793)

MYC-739 19 nt Target #3: 5'-AUAUCUGGAAGAAAUUCGA-3' (SEQ ID NO: 3120)

MYC-740 19 nt Target #1: 5'-UCUGGAAGAAAUUCGAGCU-3' (SEQ ID NO: 2467)

MYC-740 19 nt Target #2: 5'-AUCUGGAAGAAAUUCGAGC-3' (SEQ ID NO: 2794)

MYC-740 19 nt Target #3: 5'-UAUCUGGAAGAAAUUCGAG-3' (SEQ ID NO: 3121)

MYC-741 19 nt Target #1: 5'-CUGGAAGAAAUUCGAGCUG-3' (SEQ ID NO: 2468)

MYC-741 19 nt Target #2: 5'-UCUGGAAGAAAUUCGAGCU-3' (SEQ ID NO: 2795)

MYC-741 19 nt Target #3: 5'-AUCUGGAAGAAAUUCGAGC-3' (SEQ ID NO: 3122)

MYC-742 19 nt Target #1: 5'-UGGAAGAAAUUCGAGCUGC-3' (SEQ ID NO: 2469)

MYC-742 19 nt Target #2: 5'-CUGGAAGAAAUUCGAGCUG-3' (SEQ ID NO: 2796)

MYC-742 19 nt Target #3: 5'-UCUGGAAGAAAUUCGAGCU-3' (SEQ ID NO: 3123)

MYC-743 19 nt Target #1: 5'-GGAAGAAAUUCGAGCUGCU-3' (SEQ ID NO: 2470)

MYC-743 19 nt Target #2: 5'-UGGAAGAAAUUCGAGCUGC-3' (SEQ ID NO: 2797)

MYC-743 19 nt Target #3: 5'-CUGGAAGAAAUUCGAGCUG-3' (SEQ ID NO: 3124)

MYC-784 19 nt Target #1: 5'-AGCCGCCGCUCCGGGCUCU-3' (SEQ ID NO: 2471)

MYC-784 19 nt Target #2: 5'-UAGCCGCCGCUCCGGGCUC-3' (SEQ ID NO: 2798)

MYC-784 19 nt Target #3: 5'-CUAGCCGCCGCUCCGGGCU-3' (SEQ ID NO: 3125)

MYC-785 19 nt Target #1: 5'-GCCGCCGCUCCGGGCUCUG-3' (SEQ ID NO: 2472)

MYC-785 19 nt Target #2: 5'-AGCCGCCGCUCCGGGCUCU-3' (SEQ ID NO: 2799)

TABLE 8-continued

DsiRNA Component 19 Nucleotide Target Sequences In MYC mRNA

MYC-785 19 nt Target #3: 5'-UAGCCGCCGCUCCGGGCUC-3'(SEQ ID NO: 3126)

MYC-786 19 nt Target #1: 5'-CCGCCGCUCCGGGCUCUGC-3'(SEQ ID NO: 2473)

MYC-786 19 nt Target #2: 5'-GCCGCCGCUCCGGGCUCUG-3'(SEQ ID NO: 2800)

MYC-786 19 nt Target #3: 5'-AGCCGCCGCUCCGGGCUCU-3'(SEQ ID NO: 3127)

MYC-787 19 nt Target #1: 5'-CGCCGCUCCGGGCUCUGCU-3'(SEQ ID NO: 2474)

MYC-787 19 nt Target #2: 5'-CCGCCGCUCCGGGCUCUGC-3'(SEQ ID NO: 2801)

MYC-787 19 nt Target #3: 5'-GCCGCCGCUCCGGGCUCUG-3'(SEQ ID NO: 3128)

MYC-788 19 nt Target #1: 5'-GCCGCUCCGGGCUCUGCUC-3'(SEQ ID NO: 2475)

MYC-788 19 nt Target #2: 5'-CGCCGCUCCGGGCUCUGCU-3'(SEQ ID NO: 2802)

MYC-788 19 nt Target #3: 5'-CCGCCGCUCCGGGCUCUGC-3'(SEQ ID NO: 3129)

MYC-913 19 nt Target #1: 5'-GGAGGAGACAUGGUGAACC-3'(SEQ ID NO: 2476)

MYC-913 19 nt Target #2: 5'-GGGAGGAGACAUGGUGAAC-3'(SEQ ID NO: 2803)

MYC-913 19 nt Target #3: 5'-UGGGAGGAGACAUGGUGAA-3'(SEQ ID NO: 3130)

MYC-914 19 nt Target #1: 5'-GAGGAGACAUGGUGAACCA-3'(SEQ ID NO: 2477)

MYC-914 19 nt Target #2: 5'-GGAGGAGACAUGGUGAACC-3'(SEQ ID NO: 2804)

MYC-914 19 nt Target #3: 5'-GGGAGGAGACAUGGUGAAC-3'(SEQ ID NO: 3131)

MYC-915 19 nt Target #1: 5'-AGGAGACAUGGUGAACCAG-3'(SEQ ID NO: 2478)

MYC-915 19 nt Target #2: 5'-GAGGAGACAUGGUGAACCA-3'(SEQ ID NO: 2805)

MYC-915 19 nt Target #3: 5'-GGAGGAGACAUGGUGAACC-3'(SEQ ID NO: 3132)

MYC-916 19 nt Target #1: 5'-GGAGACAUGGUGAACCAGA-3'(SEQ ID NO: 2479)

MYC-916 19 nt Target #2: 5'-AGGAGACAUGGUGAACCAG-3'(SEQ ID NO: 2806)

MYC-916 19 nt Target #3: 5'-GAGGAGACAUGGUGAACCA-3'(SEQ ID NO: 3133)

MYC-917 19 nt Target #1: 5'-GAGACAUGGUGAACCAGAG-3'(SEQ ID NO: 2480)

MYC-917 19 nt Target #2: 5'-GGAGACAUGGUGAACCAGA-3'(SEQ ID NO: 2807)

MYC-917 19 nt Target #3: 5'-AGGAGACAUGGUGAACCAG-3'(SEQ ID NO: 3134)

MYC-952 19 nt Target #1: 5'-GACGACGAGACCUUCAUCA-3'(SEQ ID NO: 2481)

MYC-952 19 nt Target #2: 5'-GGACGACGAGACCUUCAUC-3'(SEQ ID NO: 2808)

TABLE 8-continued

DsiRNA Component 19 Nucleotide Target Sequences In MYC mRNA

MYC-952 19 nt Target #3: 5'-CGGACGACGAGACCUUCAU-3' (SEQ ID NO: 3135)

MYC-953 19 nt Target #1: 5'-ACGACGAGACCUUCAUCAA-3' (SEQ ID NO: 2482)

MYC-953 19 nt Target #2: 5'-GACGACGAGACCUUCAUCA-3' (SEQ ID NO: 2809)

MYC-953 19 nt Target #3: 5'-GGACGACGAGACCUUCAUC-3' (SEQ ID NO: 3136)

MYC-973 19 nt Target #1: 5'-AACAUCAUCAUCCAGGACU-3' (SEQ ID NO: 2483)

MYC-973 19 nt Target #2: 5'-AAACAUCAUCAUCCAGGAC-3' (SEQ ID NO: 2810)

MYC-973 19 nt Target #3: 5'-AAAACAUCAUCAUCCAGGA-3' (SEQ ID NO: 3137)

MYC-974 19 nt Target #1: 5'-ACAUCAUCAUCCAGGACUG-3' (SEQ ID NO: 2484)

MYC-974 19 nt Target #2: 5'-AACAUCAUCAUCCAGGACU-3' (SEQ ID NO: 2811)

MYC-974 19 nt Target #3: 5'-AAACAUCAUCAUCCAGGAC-3' (SEQ ID NO: 3138)

MYC-975 19 nt Target #1: 5'-CAUCAUCAUCCAGGACUGU-3' (SEQ ID NO: 2485)

MYC-975 19 nt Target #2: 5'-ACAUCAUCAUCCAGGACUG-3' (SEQ ID NO: 2812)

MYC-975 19 nt Target #3: 5'-AACAUCAUCAUCCAGGACU-3' (SEQ ID NO: 3139)

MYC-976 19 nt Target #1: 5'-AUCAUCAUCCAGGACUGUA-3' (SEQ ID NO: 2486)

MYC-976 19 nt Target #2: 5'-CAUCAUCAUCCAGGACUGU-3' (SEQ ID NO: 2813)

MYC-976 19 nt Target #3: 5'-ACAUCAUCAUCCAGGACUG-3' (SEQ ID NO: 3140)

MYC-977 19 nt Target #1: 5'-UCAUCAUCCAGGACUGUAU-3' (SEQ ID NO: 2487)

MYC-977 19 nt Target #2: 5'-AUCAUCAUCCAGGACUGUA-3' (SEQ ID NO: 2814)

MYC-977 19 nt Target #3: 5'-CAUCAUCAUCCAGGACUGU-3' (SEQ ID NO: 3141)

MYC-978 19 nt Target #1: 5'-CAUCAUCCAGGACUGUAUG-3' (SEQ ID NO: 2488)

MYC-978 19 nt Target #2: 5'-UCAUCAUCCAGGACUGUAU-3' (SEQ ID NO: 2815)

MYC-978 19 nt Target #3: 5'-AUCAUCAUCCAGGACUGUA-3' (SEQ ID NO: 3142)

MYC-979 19 nt Target #1: 5'-AUCAUCCAGGACUGUAUGU-3' (SEQ ID NO: 2489)

MYC-979 19 nt Target #2: 5'-CAUCAUCCAGGACUGUAUG-3' (SEQ ID NO: 2816)

MYC-979 19 nt Target #3: 5'-UCAUCAUCCAGGACUGUAU-3' (SEQ ID NO: 3143)

MYC-980 19 nt Target #1: 5'-UCAUCCAGGACUGUAUGUG-3' (SEQ ID NO: 2490)

MYC-980 19 nt Target #2: 5'-AUCAUCCAGGACUGUAUGU-3' (SEQ ID NO: 2817)

TABLE 8-continued

DsiRNA Component 19 Nucleotide Target Sequences In MYC mRNA

MYC-980 19 nt Target #3: 5'-CAUCAUCCAGGACUGUAUG-3'(SEQ ID NO: 3144)

MYC-981 19 nt Target #1: 5'-CAUCCAGGACUGUAUGUGG-3'(SEQ ID NO: 2491)

MYC-981 19 nt Target #2: 5'-UCAUCCAGGACUGUAUGUG-3'(SEQ ID NO: 2818)

MYC-981 19 nt Target #3: 5'-AUCAUCCAGGACUGUAUGU-3'(SEQ ID NO: 3145)

MYC-982 19 nt Target #1: 5'-AUCCAGGACUGUAUGUGGA-3'(SEQ ID NO: 2492)

MYC-982 19 nt Target #2: 5'-CAUCCAGGACUGUAUGUGG-3'(SEQ ID NO: 2819)

MYC-982 19 nt Target #3: 5'-UCAUCCAGGACUGUAUGUG-3'(SEQ ID NO: 3146)

MYC-983 19 nt Target #1: 5'-UCCAGGACUGUAUGUGGAG-3'(SEQ ID NO: 2493)

MYC-983 19 nt Target #2: 5'-AUCCAGGACUGUAUGUGGA-3'(SEQ ID NO: 2820)

MYC-983 19 nt Target #3: 5'-CAUCCAGGACUGUAUGUGG-3'(SEQ ID NO: 3147)

MYC-984 19 nt Target #1: 5'-CCAGGACUGUAUGUGGAGC-3'(SEQ ID NO: 2494)

MYC-984 19 nt Target #2: 5'-UCCAGGACUGUAUGUGGAG-3'(SEQ ID NO: 2821)

MYC-984 19 nt Target #3: 5'-AUCCAGGACUGUAUGUGGA-3'(SEQ ID NO: 3148)

MYC-985 19 nt Target #1: 5'-CAGGACUGUAUGUGGAGCG-3'(SEQ ID NO: 2495)

MYC-985 19 nt Target #2: 5'-CCAGGACUGUAUGUGGAGC-3'(SEQ ID NO: 2822)

MYC-985 19 nt Target #3: 5'-UCCAGGACUGUAUGUGGAG-3'(SEQ ID NO: 3149)

MYC-986 19 nt Target #1: 5'-AGGACUGUAUGUGGAGCGG-3'(SEQ ID NO: 2496)

MYC-986 19 nt Target #2: 5'-CAGGACUGUAUGUGGAGCG-3'(SEQ ID NO: 2823)

MYC-986 19 nt Target #3: 5'-CCAGGACUGUAUGUGGAGC-3'(SEQ ID NO: 3150)

MYC-1033 19 nt Target #1:5'-GAGAAGCUGGCCUCCUACC-3'(SEQ ID NO: 2497)

MYC-1033 19 nt Target #2:5'-AGAGAAGCUGGCCUCCUAC-3'(SEQ ID NO: 2824)

MYC-1033 19 nt Target #3:5'-CAGAGAAGCUGGCCUCCUA-3'(SEQ ID NO: 3151)

MYC-1034 19 nt Target #1:5'-AGAAGCUGGCCUCCUACCA-3'(SEQ ID NO: 2498)

MYC-1034 19 nt Target #2:5'-GAGAAGCUGGCCUCCUACC-3'(SEQ ID NO: 2825)

MYC-1034 19 nt Target #3:5'-AGAGAAGCUGGCCUCCUAC-3'(SEQ ID NO: 3152)

MYC-1035 19 nt Target #1:5'-GAAGCUGGCCUCCUACCAG-3'(SEQ ID NO: 2499)

MYC-1035 19 nt Target #2:5'-AGAAGCUGGCCUCCUACCA-3'(SEQ ID NO: 2826)

TABLE 8-continued

DsiRNA Component 19 Nucleotide Target Sequences In MYC mRNA

MYC-1035 19 nt Target #3: 5'-GAGAAGCUGGCCUCCUACC-3' (SEQ ID NO: 3153)

MYC-1036 19 nt Target #1: 5'-AAGCUGGCCUCCUACCAGG-3' (SEQ ID NO: 2500)

MYC-1036 19 nt Target #2: 5'-GAAGCUGGCCUCCUACCAG-3' (SEQ ID NO: 2827)

MYC-1036 19 nt Target #3: 5'-AGAAGCUGGCCUCCUACCA-3' (SEQ ID NO: 3154)

MYC-1037 19 nt Target #1: 5'-AGCUGGCCUCCUACCAGGC-3' (SEQ ID NO: 2501)

MYC-1037 19 nt Target #2: 5'-AAGCUGGCCUCCUACCAGG-3' (SEQ ID NO: 2828)

MYC-1037 19 nt Target #3: 5'-GAAGCUGGCCUCCUACCAG-3' (SEQ ID NO: 3155)

MYC-1038 19 nt Target #1: 5'-GCUGGCCUCCUACCAGGCU-3' (SEQ ID NO: 2502)

MYC-1038 19 nt Target #2: 5'-AGCUGGCCUCCUACCAGGC-3' (SEQ ID NO: 2829)

MYC-1038 19 nt Target #3: 5'-AAGCUGGCCUCCUACCAGG-3' (SEQ ID NO: 3156)

MYC-1039 19 nt Target #1: 5'-CUGGCCUCCUACCAGGCUG-3' (SEQ ID NO: 2503)

MYC-1039 19 nt Target #2: 5'-GCUGGCCUCCUACCAGGCU-3' (SEQ ID NO: 2830)

MYC-1039 19 nt Target #3: 5'-AGCUGGCCUCCUACCAGGC-3' (SEQ ID NO: 3157)

MYC-1040 19 nt Target #1: 5'-UGGCCUCCUACCAGGCUGC-3' (SEQ ID NO: 2504)

MYC-1040 19 nt Target #2: 5'-CUGGCCUCCUACCAGGCUG-3' (SEQ ID NO: 2831)

MYC-1040 19 nt Target #3: 5'-GCUGGCCUCCUACCAGGCU-3' (SEQ ID NO: 3158)

MYC-1041 19 nt Target #1: 5'-GGCCUCCUACCAGGCUGCG-3' (SEQ ID NO: 2505)

MYC-1041 19 nt Target #2: 5'-UGGCCUCCUACCAGGCUGC-3' (SEQ ID NO: 2832)

MYC-1041 19 nt Target #3: 5'-CUGGCCUCCUACCAGGCUG-3' (SEQ ID NO: 3159)

MYC-1042 19 nt Target #1: 5'-GCCUCCUACCAGGCUGCGC-3' (SEQ ID NO: 2506)

MYC-1042 19 nt Target #2: 5'-GGCCUCCUACCAGGCUGCG-3' (SEQ ID NO: 2833)

MYC-1042 19 nt Target #3: 5'-UGGCCUCCUACCAGGCUGC-3' (SEQ ID NO: 3160)

MYC-1043 19 nt Target #1: 5'-CCUCCUACCAGGCUGCGCG-3' (SEQ ID NO: 2507)

MYC-1043 19 nt Target #2: 5'-GCCUCCUACCAGGCUGCGC-3' (SEQ ID NO: 2834)

MYC-1043 19 nt Target #3: 5'-GGCCUCCUACCAGGCUGCG-3' (SEQ ID NO: 3161)

MYC-1044 19 nt Target #1: 5'-CUCCUACCAGGCUGCGCGC-3' (SEQ ID NO: 2508)

MYC-1044 19 nt Target #2: 5'-CCUCCUACCAGGCUGCGCG-3' (SEQ ID NO: 2835)

TABLE 8-continued

DsiRNA Component 19 Nucleotide Target Sequences In MYC mRNA

MYC-1044 19 nt Target #3:5'-GCCUCCUACCAGGCUGCGC-3'(SEQ ID NO: 3162)

MYC-1045 19 nt Target #1:5'-UCCUACCAGGCUGCGCGCA-3'(SEQ ID NO: 2509)

MYC-1045 19 nt Target #2:5'-CUCCUACCAGGCUGCGCGC-3'(SEQ ID NO: 2836)

MYC-1045 19 nt Target #3:5'-CCUCCUACCAGGCUGCGCG-3'(SEQ ID NO: 3163)

MYC-1046 19 nt Target #1:5'-CCUACCAGGCUGCGCGCAA-3'(SEQ ID NO: 2510)

MYC-1046 19 nt Target #2:5'-UCCUACCAGGCUGCGCGCA-3'(SEQ ID NO: 2837)

MYC-1046 19 nt Target #3:5'-CUCCUACCAGGCUGCGCGC-3'(SEQ ID NO: 3164)

MYC-1047 19 nt Target #1:5'-CUACCAGGCUGCGCGCAAA-3'(SEQ ID NO: 2511)

MYC-1047 19 nt Target #2:5'-CCUACCAGGCUGCGCGCAA-3'(SEQ ID NO: 2838)

MYC-1047 19 nt Target #3:5'-UCCUACCAGGCUGCGCGCA-3'(SEQ ID NO: 3165)

MYC-1048 19 nt Target #1:5'-UACCAGGCUGCGCGCAAAG-3'(SEQ ID NO: 2512)

MYC-1048 19 nt Target #2:5'-CUACCAGGCUGCGCGCAAA-3'(SEQ ID NO: 2839)

MYC-1048 19 nt Target #3:5'-CCUACCAGGCUGCGCGCAA-3'(SEQ ID NO: 3166)

MYC-1049 19 nt Target #1:5'-ACCAGGCUGCGCGCAAAGA-3'(SEQ ID NO: 2513)

MYC-1049 19 nt Target #2:5'-UACCAGGCUGCGCGCAAAG-3'(SEQ ID NO: 2840)

MYC-1049 19 nt Target #3:5'-CUACCAGGCUGCGCGCAAA-3'(SEQ ID NO: 3167)

MYC-1050 19 nt Target #1:5'-CCAGGCUGCGCGCAAAGAC-3'(SEQ ID NO: 2514)

MYC-1050 19 nt Target #2:5'-ACCAGGCUGCGCGCAAAGA-3'(SEQ ID NO: 2841)

MYC-1050 19 nt Target #3:5'-UACCAGGCUGCGCGCAAAG-3'(SEQ ID NO: 3168)

MYC-1051 19 nt Target #1:5'-CAGGCUGCGCGCAAAGACA-3'(SEQ ID NO: 2515)

MYC-1051 19 nt Target #2:5'-CCAGGCUGCGCGCAAAGAC-3'(SEQ ID NO: 2842)

MYC-1051 19 nt Target #3:5'-ACCAGGCUGCGCGCAAAGA-3'(SEQ ID NO: 3169)

MYC-1052 19 nt Target #1:5'-AGGCUGCGCGCAAAGACAG-3'(SEQ ID NO: 2516)

MYC-1052 19 nt Target #2:5'-CAGGCUGCGCGCAAAGACA-3'(SEQ ID NO: 2843)

MYC-1052 19 nt Target #3:5'-CCAGGCUGCGCGCAAAGAC-3'(SEQ ID NO: 3170)

MYC-1053 19 nt Target #1:5'-GGCUGCGCGCAAAGACAGC-3'(SEQ ID NO: 2517)

MYC-1053 19 nt Target #2:5'-AGGCUGCGCGCAAAGACAG-3'(SEQ ID NO: 2844)

TABLE 8-continued

DsiRNA Component 19 Nucleotide Target Sequences In MYC mRNA

MYC-1053 19 nt Target #3: 5'-CAGGCUGCGCGCAAAGACA-3' (SEQ ID NO: 3171)

MYC-1096 19 nt Target #1: 5'-CACAGCGUCUGCUCCACCU-3' (SEQ ID NO: 2518)

MYC-1096 19 nt Target #2: 5'-CCACAGCGUCUGCUCCACC-3' (SEQ ID NO: 2845)

MYC-1096 19 nt Target #3: 5'-GCCACAGCGUCUGCUCCAC-3' (SEQ ID NO: 3172)

MYC-1097 19 nt Target #1: 5'-ACAGCGUCUGCUCCACCUC-3' (SEQ ID NO: 2519)

MYC-1097 19 nt Target #2: 5'-CACAGCGUCUGCUCCACCU-3' (SEQ ID NO: 2846)

MYC-1097 19 nt Target #3: 5'-CCACAGCGUCUGCUCCACC-3' (SEQ ID NO: 3173)

MYC-1098 19 nt Target #1: 5'-CAGCGUCUGCUCCACCUCC-3' (SEQ ID NO: 2520)

MYC-1098 19 nt Target #2: 5'-ACAGCGUCUGCUCCACCUC-3' (SEQ ID NO: 2847)

MYC-1098 19 nt Target #3: 5'-CACAGCGUCUGCUCCACCU-3' (SEQ ID NO: 3174)

MYC-1099 19 nt Target #1: 5'-AGCGUCUGCUCCACCUCCA-3' (SEQ ID NO: 2521)

MYC-1099 19 nt Target #2: 5'-CAGCGUCUGCUCCACCUCC-3' (SEQ ID NO: 2848)

MYC-1099 19 nt Target #3: 5'-ACAGCGUCUGCUCCACCUC-3' (SEQ ID NO: 3175)

MYC-1100 19 nt Target #1: 5'-GCGUCUGCUCCACCUCCAG-3' (SEQ ID NO: 2522)

MYC-1100 19 nt Target #2: 5'-AGCGUCUGCUCCACCUCCA-3' (SEQ ID NO: 2849)

MYC-1100 19 nt Target #3: 5'-CAGCGUCUGCUCCACCUCC-3' (SEQ ID NO: 3176)

MYC-1101 19 nt Target #1: 5'-CGUCUGCUCCACCUCCAGC-3' (SEQ ID NO: 2523)

MYC-1101 19 nt Target #2: 5'-GCGUCUGCUCCACCUCCAG-3' (SEQ ID NO: 2850)

MYC-1101 19 nt Target #3: 5'-AGCGUCUGCUCCACCUCCA-3' (SEQ ID NO: 3177)

MYC-1189 19 nt Target #1: 5'-CUCAACGACAGCAGCUCGC-3' (SEQ ID NO: 2524)

MYC-1189 19 nt Target #2: 5'-UCUCAACGACAGCAGCUCG-3' (SEQ ID NO: 2851)

MYC-1189 19 nt Target #3: 5'-CUCUCAACGACAGCAGCUC-3' (SEQ ID NO: 3178)

MYC-1190 19 nt Target #1: 5'-UCAACGACAGCAGCUCGCC-3' (SEQ ID NO: 2525)

MYC-1190 19 nt Target #2: 5'-CUCAACGACAGCAGCUCGC-3' (SEQ ID NO: 2852)

MYC-1190 19 nt Target #3: 5'-UCUCAACGACAGCAGCUCG-3' (SEQ ID NO: 3179)

MYC-1191 19 nt Target #1: 5'-CAACGACAGCAGCUCGCCC-3' (SEQ ID NO: 2526)

MYC-1191 19 nt Target #2: 5'-UCAACGACAGCAGCUCGCC-3' (SEQ ID NO: 2853)

TABLE 8-continued

DsiRNA Component 19 Nucleotide Target Sequences In MYC mRNA

MYC-1191 19 nt Target #3:5'-CUCAACGACAGCAGCUCGC-3'(SEQ ID NO: 3180)

MYC-1192 19 nt Target #1:5'-AACGACAGCAGCUCGCCCA-3'(SEQ ID NO: 2527)

MYC-1192 19 nt Target #2:5'-CAACGACAGCAGCUCGCCC-3'(SEQ ID NO: 2854)

MYC-1192 19 nt Target #3:5'-UCAACGACAGCAGCUCGCC-3'(SEQ ID NO: 3181)

MYC-1193 19 nt Target #1:5'-ACGACAGCAGCUCGCCCAA-3'(SEQ ID NO: 2528)

MYC-1193 19 nt Target #2:5'-AACGACAGCAGCUCGCCCA-3'(SEQ ID NO: 2855)

MYC-1193 19 nt Target #3:5'-CAACGACAGCAGCUCGCCC-3'(SEQ ID NO: 3182)

MYC-1315 19 nt Target #1:5'-CAUGAGGAGACACCGCCCA-3'(SEQ ID NO: 2529)

MYC-1315 19 nt Target #2:5'-CCAUGAGGAGACACCGCCC-3'(SEQ ID NO: 2856)

MYC-1315 19 nt Target #3:5'-UCCAUGAGGAGACACCGCC-3'(SEQ ID NO: 3183)

MYC-1316 19 nt Target #1:5'-AUGAGGAGACACCGCCCAC-3'(SEQ ID NO: 2530)

MYC-1316 19 nt Target #2:5'-CAUGAGGAGACACCGCCCA-3'(SEQ ID NO: 2857)

MYC-1316 19 nt Target #3:5'-CCAUGAGGAGACACCGCCC-3'(SEQ ID NO: 3184)

MYC-1317 19 nt Target #1:5'-UGAGGAGACACCGCCCACC-3'(SEQ ID NO: 2531)

MYC-1317 19 nt Target #2:5'-AUGAGGAGACACCGCCCAC-3'(SEQ ID NO: 2858)

MYC-1317 19 nt Target #3:5'-CAUGAGGAGACACCGCCCA-3'(SEQ ID NO: 3185)

MYC-1318 19 nt Target #1:5'-GAGGAGACACCGCCCACCA-3'(SEQ ID NO: 2532)

MYC-1318 19 nt Target #2:5'-UGAGGAGACACCGCCCACC-3'(SEQ ID NO: 2859)

MYC-1318 19 nt Target #3:5'-AUGAGGAGACACCGCCCAC-3'(SEQ ID NO: 3186)

MYC-1319 19 nt Target #1:5'-AGGAGACACCGCCCACCAC-3'(SEQ ID NO: 2533)

MYC-1319 19 nt Target #2:5'-GAGGAGACACCGCCCACCA-3'(SEQ ID NO: 2860)

MYC-1319 19 nt Target #3:5'-UGAGGAGACACCGCCCACC-3'(SEQ ID NO: 3187)

MYC-1320 19 nt Target #1:5'-GGAGACACCGCCCACCACC-3'(SEQ ID NO: 2534)

MYC-1320 19 nt Target #2:5'-AGGAGACACCGCCCACCAC-3'(SEQ ID NO: 2861)

MYC-1320 19 nt Target #3:5'-GAGGAGACACCGCCCACCA-3'(SEQ ID NO: 3188)

MYC-1321 19 nt Target #1:5'-GAGACACCGCCCACCACCA-3'(SEQ ID NO: 2535)

MYC-1321 19 nt Target #2:5'-GGAGACACCGCCCACCACC-3'(SEQ ID NO: 2862)

TABLE 8-continued

DsiRNA Component 19 Nucleotide Target Sequences In MYC mRNA

MYC-1321 19 nt Target #3: 5'-AGGAGACACCGCCCACCAC-3' (SEQ ID NO: 3189)

MYC-1322 19 nt Target #1: 5'-AGACACCGCCCACCACCAG-3' (SEQ ID NO: 2536)

MYC-1322 19 nt Target #2: 5'-GAGACACCGCCCACCACCA-3' (SEQ ID NO: 2863)

MYC-1322 19 nt Target #3: 5'-GGAGACACCGCCCACCACC-3' (SEQ ID NO: 3190)

MYC-1323 19 nt Target #1: 5'-GACACCGCCCACCACCAGC-3' (SEQ ID NO: 2537)

MYC-1323 19 nt Target #2: 5'-AGACACCGCCCACCACCAG-3' (SEQ ID NO: 2864)

MYC-1323 19 nt Target #3: 5'-GAGACACCGCCCACCACCA-3' (SEQ ID NO: 3191)

MYC-1324 19 nt Target #1: 5'-ACACCGCCCACCACCAGCA-3' (SEQ ID NO: 2538)

MYC-1324 19 nt Target #2: 5'-GACACCGCCCACCACCAGC-3' (SEQ ID NO: 2865)

MYC-1324 19 nt Target #3: 5'-AGACACCGCCCACCACCAG-3' (SEQ ID NO: 3192)

MYC-1325 19 nt Target #1: 5'-CACCGCCCACCACCAGCAG-3' (SEQ ID NO: 2539)

MYC-1325 19 nt Target #2: 5'-ACACCGCCCACCACCAGCA-3' (SEQ ID NO: 2866)

MYC-1325 19 nt Target #3: 5'-GACACCGCCCACCACCAGC-3' (SEQ ID NO: 3193)

MYC-1326 19 nt Target #1: 5'-ACCGCCCACCACCAGCAGC-3' (SEQ ID NO: 2540)

MYC-1326 19 nt Target #2: 5'-CACCGCCCACCACCAGCAG-3' (SEQ ID NO: 2867)

MYC-1326 19 nt Target #3: 5'-ACACCGCCCACCACCAGCA-3' (SEQ ID NO: 3194)

MYC-1327 19 nt Target #1: 5'-CCGCCCACCACCAGCAGCG-3' (SEQ ID NO: 2541)

MYC-1327 19 nt Target #2: 5'-ACCGCCCACCACCAGCAGC-3' (SEQ ID NO: 2868)

MYC-1327 19 nt Target #3: 5'-CACCGCCCACCACCAGCAG-3' (SEQ ID NO: 3195)

MYC-1328 19 nt Target #1: 5'-CGCCCACCACCAGCAGCGA-3' (SEQ ID NO: 2542)

MYC-1328 19 nt Target #2: 5'-CCGCCCACCACCAGCAGCG-3' (SEQ ID NO: 2869)

MYC-1328 19 nt Target #3: 5'-ACCGCCCACCACCAGCAGC-3' (SEQ ID NO: 3196)

MYC-1329 19 nt Target #1: 5'-GCCCACCACCAGCAGCGAC-3' (SEQ ID NO: 2543)

MYC-1329 19 nt Target #2: 5'-CGCCCACCACCAGCAGCGA-3' (SEQ ID NO: 2870)

MYC-1329 19 nt Target #3: 5'-CCGCCCACCACCAGCAGCG-3' (SEQ ID NO: 3197)

MYC-1330 19 nt Target #1: 5'-CCCACCACCAGCAGCGACU-3' (SEQ ID NO: 2544)

MYC-1330 19 nt Target #2: 5'-GCCCACCACCAGCAGCGAC-3' (SEQ ID NO: 2871)

TABLE 8-continued

DsiRNA Component 19 Nucleotide Target Sequences In MYC mRNA

MYC-1330 19 nt Target #3:5'-CGCCCACCACCAGCAGCGA-3'(SEQ ID NO: 3198)

MYC-1331 19 nt Target #1:5'-CCACCACCAGCAGCGACUC-3'(SEQ ID NO: 2545)

MYC-1331 19 nt Target #2:5'-CCCACCACCAGCAGCGACU-3'(SEQ ID NO: 2872)

MYC-1331 19 nt Target #3:5'-GCCCACCACCAGCAGCGAC-3'(SEQ ID NO: 3199)

MYC-1332 19 nt Target #1:5'-CACCACCAGCAGCGACUCU-3'(SEQ ID NO: 2546)

MYC-1332 19 nt Target #2:5'-CCACCACCAGCAGCGACUC-3'(SEQ ID NO: 2873)

MYC-1332 19 nt Target #3:5'-CCCACCACCAGCAGCGACU-3'(SEQ ID NO: 3200)

MYC-1333 19 nt Target #1:5'-ACCACCAGCAGCGACUCUG-3'(SEQ ID NO: 2547)

MYC-1333 19 nt Target #2:5'-CACCACCAGCAGCGACUCU-3'(SEQ ID NO: 2874)

MYC-1333 19 nt Target #3:5'-CCACCACCAGCAGCGACUC-3'(SEQ ID NO: 3201)

MYC-1334 19 nt Target #1:5'-CCACCAGCAGCGACUCUGA-3'(SEQ ID NO: 2548)

MYC-1334 19 nt Target #2:5'-ACCACCAGCAGCGACUCUG-3'(SEQ ID NO: 2875)

MYC-1334 19 nt Target #3:5'-CACCACCAGCAGCGACUCU-3'(SEQ ID NO: 3202)

MYC-1360 19 nt Target #1:5'-CAAGAAGAUGAGGAAGAAA-3'(SEQ ID NO: 2549)

MYC-1360 19 nt Target #2:5'-ACAAGAAGAUGAGGAAGAA-3'(SEQ ID NO: 2876)

MYC-1360 19 nt Target #3:5'-AACAAGAAGAUGAGGAAGA-3'(SEQ ID NO: 3203)

MYC-1361 19 nt Target #1:5'-AAGAAGAUGAGGAAGAAAU-3'(SEQ ID NO: 2550)

MYC-1361 19 nt Target #2:5'-CAAGAAGAUGAGGAAGAAA-3'(SEQ ID NO: 2877)

MYC-1361 19 nt Target #3:5'-ACAAGAAGAUGAGGAAGAA-3'(SEQ ID NO: 3204)

MYC-1448 19 nt Target #1:5'-GAGGCCACAGCAAACCUCC-3'(SEQ ID NO: 2551)

MYC-1448 19 nt Target #2:5'-GGAGGCCACAGCAAACCUC-3'(SEQ ID NO: 2878)

MYC-1448 19 nt Target #3:5'-UGGAGGCCACAGCAAACCU-3'(SEQ ID NO: 3205)

MYC-1468 19 nt Target #1:5'-CACAGCCCACUGGUCCUCA-3'(SEQ ID NO: 2552)

MYC-1468 19 nt Target #2:5'-UCACAGCCCACUGGUCCUC-3'(SEQ ID NO: 2879)

MYC-1468 19 nt Target #3:5'-CUCACAGCCCACUGGUCCU-3'(SEQ ID NO: 3206)

MYC-1469 19 nt Target #1:5'-ACAGCCCACUGGUCCUCAA-3'(SEQ ID NO: 2553)

MYC-1469 19 nt Target #2:5'-CACAGCCCACUGGUCCUCA-3'(SEQ ID NO: 2880)

TABLE 8-continued

DsiRNA Component 19 Nucleotide Target Sequences In MYC mRNA

MYC-1469 19 nt Target #3:5'-UCACAGCCCACUGGUCCUC-3'(SEQ ID NO: 3207)

MYC-1470 19 nt Target #1:5'-CAGCCCACUGGUCCUCAAG-3'(SEQ ID NO: 2554)

MYC-1470 19 nt Target #2:5'-ACAGCCCACUGGUCCUCAA-3'(SEQ ID NO: 2881)

MYC-1470 19 nt Target #3:5'-CACAGCCCACUGGUCCUCA-3'(SEQ ID NO: 3208)

MYC-1471 19 nt Target #1:5'-AGCCCACUGGUCCUCAAGA-3'(SEQ ID NO: 2555)

MYC-1471 19 nt Target #2:5'-CAGCCCACUGGUCCUCAAG-3'(SEQ ID NO: 2882)

MYC-1471 19 nt Target #3:5'-ACAGCCCACUGGUCCUCAA-3'(SEQ ID NO: 3209)

MYC-1472 19 nt Target #1:5'-GCCCACUGGUCCUCAAGAG-3'(SEQ ID NO: 2556)

MYC-1472 19 nt Target #2:5'-AGCCCACUGGUCCUCAAGA-3'(SEQ ID NO: 2883)

MYC-1472 19 nt Target #3:5'-CAGCCCACUGGUCCUCAAG-3'(SEQ ID NO: 3210)

MYC-1473 19 nt Target #1:5'-CCCACUGGUCCUCAAGAGG-3'(SEQ ID NO: 2557)

MYC-1473 19 nt Target #2:5'-GCCCACUGGUCCUCAAGAG-3'(SEQ ID NO: 2884)

MYC-1473 19 nt Target #3:5'-AGCCCACUGGUCCUCAAGA-3'(SEQ ID NO: 3211)

MYC-1474 19 nt Target #1:5'-CCACUGGUCCUCAAGAGGU-3'(SEQ ID NO: 2558)

MYC-1474 19 nt Target #2:5'-CCCACUGGUCCUCAAGAGG-3'(SEQ ID NO: 2885)

MYC-1474 19 nt Target #3:5'-GCCCACUGGUCCUCAAGAG-3'(SEQ ID NO: 3212)

MYC-1475 19 nt Target #1:5'-CACUGGUCCUCAAGAGGUG-3'(SEQ ID NO: 2559)

MYC-1475 19 nt Target #2:5'-CCACUGGUCCUCAAGAGGU-3'(SEQ ID NO: 2886)

MYC-1475 19 nt Target #3:5'-CCCACUGGUCCUCAAGAGG-3'(SEQ ID NO: 3213)

MYC-1476 19 nt Target #1:5'-ACUGGUCCUCAAGAGGUGC-3'(SEQ ID NO: 2560)

MYC-1476 19 nt Target #2:5'-CACUGGUCCUCAAGAGGUG-3'(SEQ ID NO: 2887)

MYC-1476 19 nt Target #3:5'-CCACUGGUCCUCAAGAGGU-3'(SEQ ID NO: 3214)

MYC-1477 19 nt Target #1:5'-CUGGUCCUCAAGAGGUGCC-3'(SEQ ID NO: 2561)

MYC-1477 19 nt Target #2:5'-ACUGGUCCUCAAGAGGUGC-3'(SEQ ID NO: 2888)

MYC-1477 19 nt Target #3:5'-CACUGGUCCUCAAGAGGUG-3'(SEQ ID NO: 3215)

MYC-1478 19 nt Target #1:5'-UGGUCCUCAAGAGGUGCCA-3'(SEQ ID NO: 2562)

MYC-1478 19 nt Target #2:5'-CUGGUCCUCAAGAGGUGCC-3'(SEQ ID NO: 2889)

TABLE 8-continued

DsiRNA Component 19 Nucleotide Target Sequences In MYC mRNA

MYC-1478 19 nt Target #3: 5'-ACUGGUCCUCAAGAGGUGC-3' (SEQ ID NO: 3216)

MYC-1479 19 nt Target #1: 5'-GGUCCUCAAGAGGUGCCAC-3' (SEQ ID NO: 2563)

MYC-1479 19 nt Target #2: 5'-UGGUCCUCAAGAGGUGCCA-3' (SEQ ID NO: 2890)

MYC-1479 19 nt Target #3: 5'-CUGGUCCUCAAGAGGUGCC-3' (SEQ ID NO: 3217)

MYC-1480 19 nt Target #1: 5'-GUCCUCAAGAGGUGCCACG-3' (SEQ ID NO: 2564)

MYC-1480 19 nt Target #2: 5'-GGUCCUCAAGAGGUGCCAC-3' (SEQ ID NO: 2891)

MYC-1480 19 nt Target #3: 5'-UGGUCCUCAAGAGGUGCCA-3' (SEQ ID NO: 3218)

MYC-1481 19 nt Target #1: 5'-UCCUCAAGAGGUGCCACGU-3' (SEQ ID NO: 2565)

MYC-1481 19 nt Target #2: 5'-GUCCUCAAGAGGUGCCACG-3' (SEQ ID NO: 2892)

MYC-1481 19 nt Target #3: 5'-GGUCCUCAAGAGGUGCCAC-3' (SEQ ID NO: 3219)

MYC-1482 19 nt Target #1: 5'-CCUCAAGAGGUGCCACGUC-3' (SEQ ID NO: 2566)

MYC-1482 19 nt Target #2: 5'-UCCUCAAGAGGUGCCACGU-3' (SEQ ID NO: 2893)

MYC-1482 19 nt Target #3: 5'-GUCCUCAAGAGGUGCCACG-3' (SEQ ID NO: 3220)

MYC-1483 19 nt Target #1: 5'-CUCAAGAGGUGCCACGUCU-3' (SEQ ID NO: 2567)

MYC-1483 19 nt Target #2: 5'-CCUCAAGAGGUGCCACGUC-3' (SEQ ID NO: 2894)

MYC-1483 19 nt Target #3: 5'-UCCUCAAGAGGUGCCACGU-3' (SEQ ID NO: 3221)

MYC-1711 19 nt Target #1: 5'-AGCUUUUUGCCCUGCGUG-3' (SEQ ID NO: 2568)

MYC-1711 19 nt Target #2: 5'-GAGCUUUUUGCCCUGCGU-3' (SEQ ID NO: 2895)

MYC-1711 19 nt Target #3: 5'-GGAGCUUUUUGCCCUGCG-3' (SEQ ID NO: 3222)

MYC-1712 19 nt Target #1: 5'-GCUUUUUGCCCUGCGUGA-3' (SEQ ID NO: 2569)

MYC-1712 19 nt Target #2: 5'-AGCUUUUUGCCCUGCGUG-3' (SEQ ID NO: 2896)

MYC-1712 19 nt Target #3: 5'-GAGCUUUUUGCCCUGCGU-3' (SEQ ID NO: 3223)

MYC-1713 19 nt Target #1: 5'-CUUUUUGCCCUGCGUGAC-3' (SEQ ID NO: 2570)

MYC-1713 19 nt Target #2: 5'-GCUUUUUGCCCUGCGUGA-3' (SEQ ID NO: 2897)

MYC-1713 19 nt Target #3: 5'-AGCUUUUUGCCCUGCGUG-3' (SEQ ID NO: 3224)

MYC-1714 19 nt Target #1: 5'-UUUUUGCCCUGCGUGACC-3' (SEQ ID NO: 2571)

MYC-1714 19 nt Target #2: 5'-CUUUUUGCCCUGCGUGAC-3' (SEQ ID NO: 2898)

TABLE 8-continued

DsiRNA Component 19 Nucleotide Target Sequences In MYC mRNA

MYC-1714 19 nt Target #3:5'-GCUUUUUUGCCCUGCGUGA-3'(SEQ ID NO: 3225)

MYC-1715 19 nt Target #1:5'-UUUUUGCCCUGCGUGACCA-3'(SEQ ID NO: 2572)

MYC-1715 19 nt Target #2:5'-UUUUUUGCCCUGCGUGACC-3'(SEQ ID NO: 2899)

MYC-1715 19 nt Target #3:5'-CUUUUUUGCCCUGCGUGAC-3'(SEQ ID NO: 3226)

MYC-1716 19 nt Target #1:5'-UUUUGCCCUGCGUGACCAG-3'(SEQ ID NO: 2573)

MYC-1716 19 nt Target #2:5'-UUUUUGCCCUGCGUGACCA-3'(SEQ ID NO: 2900)

MYC-1716 19 nt Target #3:5'-UUUUUUGCCCUGCGUGACC-3'(SEQ ID NO: 3227)

MYC-1717 19 nt Target #1:5'-UUUGCCCUGCGUGACCAGA-3'(SEQ ID NO: 2574)

MYC-1717 19 nt Target #2:5'-UUUUGCCCUGCGUGACCAG-3'(SEQ ID NO: 2901)

MYC-1717 19 nt Target #3:5'-UUUUUGCCCUGCGUGACCA-3'(SEQ ID NO: 3228)

MYC-1718 19 nt Target #1:5'-UUGCCCUGCGUGACCAGAU-3'(SEQ ID NO: 2575)

MYC-1718 19 nt Target #2:5'-UUUGCCCUGCGUGACCAGA-3'(SEQ ID NO: 2902)

MYC-1718 19 nt Target #3:5'-UUUUGCCCUGCGUGACCAG-3'(SEQ ID NO: 3229)

MYC-1719 19 nt Target #1:5'-UGCCCUGCGUGACCAGAUC-3'(SEQ ID NO: 2576)

MYC-1719 19 nt Target #2:5'-UUGCCCUGCGUGACCAGAU-3'(SEQ ID NO: 2903)

MYC-1719 19 nt Target #3:5'-UUUGCCCUGCGUGACCAGA-3'(SEQ ID NO: 3230)

MYC-1720 19 nt Target #1:5'-GCCCUGCGUGACCAGAUCC-3'(SEQ ID NO: 2577)

MYC-1720 19 nt Target #2:5'-UGCCCUGCGUGACCAGAUC-3'(SEQ ID NO: 2904)

MYC-1720 19 nt Target #3:5'-UUGCCCUGCGUGACCAGAU-3'(SEQ ID NO: 3231)

MYC-1721 19 nt Target #1:5'-CCCUGCGUGACCAGAUCCC-3'(SEQ ID NO: 2578)

MYC-1721 19 nt Target #2:5'-GCCCUGCGUGACCAGAUCC-3'(SEQ ID NO: 2905)

MYC-1721 19 nt Target #3:5'-UGCCCUGCGUGACCAGAUC-3'(SEQ ID NO: 3232)

MYC-1856 19 nt Target #1:5'-GGAAACGACGAGAACAGUU-3'(SEQ ID NO: 2579)

MYC-1856 19 nt Target #2:5'-CGGAAACGACGAGAACAGU-3'(SEQ ID NO: 2906)

MYC-1856 19 nt Target #3:5'-GCGGAAACGACGAGAACAG-3'(SEQ ID NO: 3233)

MYC-1857 19 nt Target #1:5'-GAAACGACGAGAACAGUUG-3'(SEQ ID NO: 2580)

MYC-1857 19 nt Target #2:5'-GGAAACGACGAGAACAGUU-3'(SEQ ID NO: 2907)

TABLE 8-continued

DsiRNA Component 19 Nucleotide Target Sequences In MYC mRNA

MYC-1857 19 nt Target #3: 5'-CGGAAACGACGAGAACAGU-3' (SEQ ID NO: 3234)

MYC-2115 19 nt Target #1: 5'-UUUAACAGAUUUGUAUUUA-3' (SEQ ID NO: 2581)

MYC-2115 19 nt Target #2: 5'-CUUUAACAGAUUUGUAUUU-3' (SEQ ID NO: 2908)

MYC-2115 19 nt Target #3: 5'-UCUUUAACAGAUUUGUAUU-3' (SEQ ID NO: 3235)

MYC-2116 19 nt Target #1: 5'-UUAACAGAUUUGUAUUAA-3' (SEQ ID NO: 2582)

MYC-2116 19 nt Target #2: 5'-UUUAACAGAUUUGUAUUUA-3' (SEQ ID NO: 2909)

MYC-2116 19 nt Target #3: 5'-CUUUAACAGAUUUGUAUUU-3' (SEQ ID NO: 3236)

MYC-2193 19 nt Target #1: 5'-AAAUGUAAAUAACUUUAAU-3' (SEQ ID NO: 2583)

MYC-2193 19 nt Target #2: 5'-UAAAUGUAAAUAACUUUAA-3' (SEQ ID NO: 2910)

MYC-2193 19 nt Target #3: 5'-UUAAAUGUAAAUAACUUUA-3' (SEQ ID NO: 3237)

MYC-2194 19 nt Target #1: 5'-AAUGUAAAUAACUUUAAUA-3' (SEQ ID NO: 2584)

MYC-2194 19 nt Target #2: 5'-AAAUGUAAAUAACUUUAAU-3' (SEQ ID NO: 2911)

MYC-2194 19 nt Target #3: 5'-UAAAUGUAAAUAACUUUAA-3' (SEQ ID NO: 3238)

MYC-2195 19 nt Target #1: 5'-AUGUAAAUAACUUUAAUAA-3' (SEQ ID NO: 2585)

MYC-2195 19 nt Target #2: 5'-AAUGUAAAUAACUUUAAUA-3' (SEQ ID NO: 2912)

MYC-2195 19 nt Target #3: 5'-AAAUGUAAAUAACUUUAAU-3' (SEQ ID NO: 3239)

MYC-2196 19 nt Target #1: 5'-UGUAAAUAACUUUAAUAAA-3' (SEQ ID NO: 2586)

MYC-2196 19 nt Target #2: 5'-AUGUAAAUAACUUUAAUAA-3' (SEQ ID NO: 2913)

MYC-2196 19 nt Target #3: 5'-AAUGUAAAUAACUUUAAUA-3' (SEQ ID NO: 3240)

MYC-2197 19 nt Target #1: 5'-GUAAAUAACUUUAAUAAAA-3' (SEQ ID NO: 2587)

MYC-2197 19 nt Target #2: 5'-UGUAAAUAACUUUAAUAAA-3' (SEQ ID NO: 2914)

MYC-2197 19 nt Target #3: 5'-AUGUAAAUAACUUUAAUAA-3' (SEQ ID NO: 3241)

MYC-2198 19 nt Target #1: 5'-UAAAUAACUUUAAUAAAAC-3' (SEQ ID NO: 2588)

MYC-2198 19 nt Target #2: 5'-GUAAAUAACUUUAAUAAAA-3' (SEQ ID NO: 2915)

MYC-2198 19 nt Target #3: 5'-UGUAAAUAACUUUAAUAAA-3' (SEQ ID NO: 3242)

MYC-2199 19 nt Target #1: 5'-AAAUAACUUUAAUAAAACG-3' (SEQ ID NO: 2589)

MYC-2199 19 nt Target #2: 5'-UAAAUAACUUUAAUAAAAC-3' (SEQ ID NO: 2916)

TABLE 8-continued

DsiRNA Component 19 Nucleotide Target Sequences In MYC mRNA

MYC-2199 19 nt Target #3: 5'-GUAAAUAACUUUAAUAAAA-3' (SEQ ID NO: 3243)

MYC-2200 19 nt Target #1: 5'-AAUAACUUUAAUAAAACGU-3' (SEQ ID NO: 2590)

MYC-2200 19 nt Target #2: 5'-AAAUAACUUUAAUAAAACG-3' (SEQ ID NO: 2917)

MYC-2200 19 nt Target #3: 5'-UAAAUAACUUUAAUAAAAC-3' (SEQ ID NO: 3244)

MYC-2201 19 nt Target #1: 5'-AUAACUUUAAUAAAACGUU-3' (SEQ ID NO: 2591)

MYC-2201 19 nt Target #2: 5'-AAUAACUUUAAUAAAACGU-3' (SEQ ID NO: 2918)

MYC-2201 19 nt Target #3: 5'-AAAUAACUUUAAUAAAACG-3' (SEQ ID NO: 3245)

MYC-2202 19 nt Target #1: 5'-UAACUUUAAUAAAACGUUU-3' (SEQ ID NO: 2592)

MYC-2202 19 nt Target #2: 5'-AUAACUUUAAUAAAACGUU-3' (SEQ ID NO: 2919)

MYC-2202 19 nt Target #3: 5'-AAUAACUUUAAUAAAACGU-3' (SEQ ID NO: 3246)

MYC-2203 19 nt Target #1: 5'-AACUUUAAUAAAACGUUUA-3' (SEQ ID NO: 2593)

MYC-2203 19 nt Target #2: 5'-UAACUUUAAUAAAACGUUU-3' (SEQ ID NO: 2920)

MYC-2203 19 nt Target #3: 5'-AUAACUUUAAUAAAACGUU-3' (SEQ ID NO: 3247)

MYC-2204 19 nt Target #1: 5'-ACUUUAAUAAAACGUUUAU-3' (SEQ ID NO: 2594)

MYC-2204 19 nt Target #2: 5'-AACUUUAAUAAAACGUUUA-3' (SEQ ID NO: 2921)

MYC-2204 19 nt Target #3: 5'-UAACUUUAAUAAAACGUUU-3' (SEQ ID NO: 3248)

MYC-2205 19 nt Target #1: 5'-CUUUAAUAAAACGUUUAUA-3' (SEQ ID NO: 2595)

MYC-2205 19 nt Target #2: 5'-ACUUUAAUAAAACGUUUAU-3' (SEQ ID NO: 2922)

MYC-2205 19 nt Target #3: 5'-AACUUUAAUAAAACGUUUA-3' (SEQ ID NO: 3249)

MYC-2313 19 nt Target #1: 5'-UUUUUAAAGUUGAUUUUUU-3' (SEQ ID NO: 2596)

MYC-2313 19 nt Target #2: 5'-CUUUUUAAAGUUGAUUUUU-3' (SEQ ID NO: 2923)

MYC-2313 19 nt Target #3: 5'-GCUUUUUAAAGUUGAUUUU-3' (SEQ ID NO: 3250)

MYC-2314 19 nt Target #1: 5'-UUUUAAAGUUGAUUUUUUU-3' (SEQ ID NO: 2597)

MYC-2314 19 nt Target #2: 5'-UUUUUAAAGUUGAUUUUUU-3' (SEQ ID NO: 2924)

MYC-2314 19 nt Target #3: 5'-CUUUUUAAAGUUGAUUUUU-3' (SEQ ID NO: 3251)

MYC-2315 19 nt Target #1: 5'-UUUAAAGUUGAUUUUUUUC-3' (SEQ ID NO: 2598)

MYC-2315 19 nt Target #2: 5'-UUUUAAAGUUGAUUUUUUU-3' (SEQ ID NO: 2925)

TABLE 8-continued

DsiRNA Component 19 Nucleotide Target Sequences In MYC mRNA

MYC-2315 19 nt Target #3: 5'-UUUUUAAAGUUGAUUUUUU-3' (SEQ ID NO: 3252)

MYC-2316 19 nt Target #1: 5'-UUAAAGUUGAUUUUUUUCU-3' (SEQ ID NO: 2599)

MYC-2316 19 nt Target #2: 5'-UUUAAAGUUGAUUUUUUUC-3' (SEQ ID NO: 2926)

MYC-2316 19 nt Target #3: 5'-UUUUAAAGUUGAUUUUUUU-3' (SEQ ID NO: 3253)

MYC-2317 19 nt Target #1: 5'-UAAAGUUGAUUUUUUCUA-3' (SEQ ID NO: 2600)

MYC-2317 19 nt Target #2: 5'-UUAAAGUUGAUUUUUUUCU-3' (SEQ ID NO: 2927)

MYC-2317 19 nt Target #3: 5'-UUUAAAGUUGAUUUUUUUC-3' (SEQ ID NO: 3254)

MYC-2318 19 nt Target #1: 5'-AAAGUUGAUUUUUUCUAU-3' (SEQ ID NO: 2601)

MYC-2318 19 nt Target #2: 5'-UAAAGUUGAUUUUUUCUA-3' (SEQ ID NO: 2928)

MYC-2318 19 nt Target #3: 5'-UUAAAGUUGAUUUUUUUCU-3' (SEQ ID NO: 3255)

MYC-2319 19 nt Target #1: 5'-AAGUUGAUUUUUUCUAUU-3' (SEQ ID NO: 2602)

MYC-2319 19 nt Target #2: 5'-AAAGUUGAUUUUUUCUAU-3' (SEQ ID NO: 2929)

MYC-2319 19 nt Target #3: 5'-UAAAGUUGAUUUUUUCUA-3' (SEQ ID NO: 3256)

MYC-2320 19 nt Target #1: 5'-AGUUGAUUUUUUCUAUUG-3' (SEQ ID NO: 2603)

MYC-2320 19 nt Target #2: 5'-AAGUUGAUUUUUUCUAUU-3' (SEQ ID NO: 2930)

MYC-2320 19 nt Target #3: 5'-AAAGUUGAUUUUUUCUAU-3' (SEQ ID NO: 3257)

MYC-2321 19 nt Target #1: 5'-GUUGAUUUUUUCUAUUGU-3' (SEQ ID NO: 2604)

MYC-2321 19 nt Target #2: 5'-AGUUGAUUUUUUCUAUUG-3' (SEQ ID NO: 2931)

MYC-2321 19 nt Target #3: 5'-AAGUUGAUUUUUUCUAUU-3' (SEQ ID NO: 3258)

MYC-2322 19 nt Target #1: 5'-UUGAUUUUUUCUAUUGUU-3' (SEQ ID NO: 2605)

MYC-2322 19 nt Target #2: 5'-GUUGAUUUUUUCUAUUGU-3' (SEQ ID NO: 2932)

MYC-2322 19 nt Target #3: 5'-AGUUGAUUUUUUCUAUUG-3' (SEQ ID NO: 3259)

MYC-2323 19 nt Target #1: 5'-UGAUUUUUUCUAUUGUUU-3' (SEQ ID NO: 2606)

MYC-2323 19 nt Target #2: 5'-UUGAUUUUUUCUAUUGUU-3' (SEQ ID NO: 2933)

MYC-2323 19 nt Target #3: 5'-GUUGAUUUUUUCUAUUGU-3' (SEQ ID NO: 3260)

MYC-2324 19 nt Target #1: 5'-GAUUUUUUCUAUUGUUU-3' (SEQ ID NO: 2607)

MYC-2324 19 nt Target #2: 5'-UGAUUUUUUCUAUUGUUU-3' (SEQ ID NO: 2934)

TABLE 8-continued

DsiRNA Component 19 Nucleotide Target Sequences In MYC mRNA

MYC-2324 19 nt Target #3:5'-UUGAUUUUUUCUAUUGUU-3'(SEQ ID NO: 3261)

MYC-2325 19 nt Target #1:5'-AUUUUUUCUAUUGUUUUU-3'(SEQ ID NO: 2608)

MYC-2325 19 nt Target #2:5'-GAUUUUUUCUAUUGUUUU-3'(SEQ ID NO: 2935)

MYC-2325 19 nt Target #3:5'-UGAUUUUUUCUAUUGUUU-3'(SEQ ID NO: 3262)

MYC-2326 19 nt Target #1:5'-UUUUUUCUAUUGUUUUA-3'(SEQ ID NO: 2609)

MYC-2326 19 nt Target #2:5'-AUUUUUUCUAUUGUUUU-3'(SEQ ID NO: 2936)

MYC-2326 19 nt Target #3:5'-GAUUUUUUCUAUUGUUU-3'(SEQ ID NO: 3263)

MYC-2327 19 nt Target #1:5'-UUUUUCUAUUGUUUUAG-3'(SEQ ID NO: 2610)

MYC-2327 19 nt Target #2:5'-UUUUUUCUAUUGUUUUA-3'(SEQ ID NO: 2937)

MYC-2327 19 nt Target #3:5'-AUUUUUUCUAUUGUUUU-3'(SEQ ID NO: 3264)

MYC-2328 19 nt Target #1:5'-UUUUCUAUUGUUUUAGA-3'(SEQ ID NO: 2611)

MYC-2328 19 nt Target #2:5'-UUUUUCUAUUGUUUUAG-3'(SEQ ID NO: 2938)

MYC-2328 19 nt Target #3:5'-UUUUUUCUAUUGUUUUA-3'(SEQ ID NO: 3265)

MYC-2329 19 nt Target #1:5'-UUUCUAUUGUUUUAGAA-3'(SEQ ID NO: 2612)

MYC-2329 19 nt Target #2:5'-UUUUCUAUUGUUUUAGA-3'(SEQ ID NO: 2939)

MYC-2329 19 nt Target #3:5'-UUUUUCUAUUGUUUUAG-3'(SEQ ID NO: 3266)

MYC-2330 19 nt Target #1:5'-UUCUAUUGUUUUAGAAA-3'(SEQ ID NO: 2613)

MYC-2330 19 nt Target #2:5'-UUUCUAUUGUUUUAGAA-3'(SEQ ID NO: 2940)

MYC-2330 19 nt Target #3:5'-UUUUCUAUUGUUUUAGA-3'(SEQ ID NO: 3267)

MYC-2331 19 nt Target #1:5'-UCUAUUGUUUUAGAAAA-3'(SEQ ID NO: 2614)

MYC-2331 19 nt Target #2:5'-UUCUAUUGUUUUAGAAA-3'(SEQ ID NO: 2941)

MYC-2331 19 nt Target #3:5'-UUUCUAUUGUUUUAGAA-3'(SEQ ID NO: 3268)

MYC-2332 19 nt Target #1:5'-CUAUUGUUUUAGAAAAA-3'(SEQ ID NO: 2615)

MYC-2332 19 nt Target #2:5'-UCUAUUGUUUUAGAAAA-3'(SEQ ID NO: 2942)

MYC-2332 19 nt Target #3:5'-UUCUAUUGUUUUAGAAA-3'(SEQ ID NO: 3269)

MYC-2333 19 nt Target #1:5'-UAUUGUUUUAGAAAAAA-3'(SEQ ID NO: 2616)

MYC-2333 19 nt Target #2:5'-CUAUUGUUUUAGAAAAA-3'(SEQ ID NO: 2943)

TABLE 8-continued

DsiRNA Component 19 Nucleotide Target Sequences In MYC mRNA

MYC-2333 19 nt Target #3:5'-UUCUAUUGUUUUUAGAAAA-3'(SEQ ID NO: 3270)

Within Tables 2-4 and 6-7 above, underlined residues indicate 2'-O-methyl residues, UPPER CASE indicates ribonucleotides, and lower case denotes deoxyribonucleotides. The DsiRNA agents of Tables 2-4 above are 25/27mer agents possessing a blunt end. The structures and/or modification patterning of the agents of Tables 2-4 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of MYC expression. Similarly, the 27mer "blunt/fray" and "blunt/blunt" DsiRNA structures and/or modification patterns of the agents of Tables 6-7 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the MYC transcript as the asymmetric "25/27" structures shown in Tables 2-4 herein. Exemplary "27/27" DsiRNAs are optionally designed with a "blunt/fray" structure as shown for the DsiRNAs of Table 6 above, or with a "blunt/blunt" structure as shown for the DsiRNAs of Table 7 above.

In certain embodiments, the dsRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

By definition, "sufficiently complementary" (contrasted with, e.g., "100% complementary") allows for one or more mismatches to exist between a dsRNA of the invention and the target RNA or cDNA sequence (e.g., MYC mRNA), provided that the dsRNA possesses complementarity sufficient to trigger the destruction of the target RNA by the RNAi machinery (e.g., the RISC complex) or process. In certain embodiments, a "sufficiently complementary" dsRNA of the invention can harbor one, two, three or even four or more mismatches between the dsRNA sequence and the target RNA or cDNA sequence (e.g., in certain such embodiments, the antisense strand of the dsRNA harbors one, two, three, four, five or even six or more mismatches when aligned with the target RNA or cDNA sequence). Additional consideration of the preferred location of such mismatches within certain dsRNAs of the instant invention is considered in greater detail below.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target MYC RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target MYC RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target MYC RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target MYC RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target MYC RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target MYC RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target MYC RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target MYC RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target MYC RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target MYC RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target MYC RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

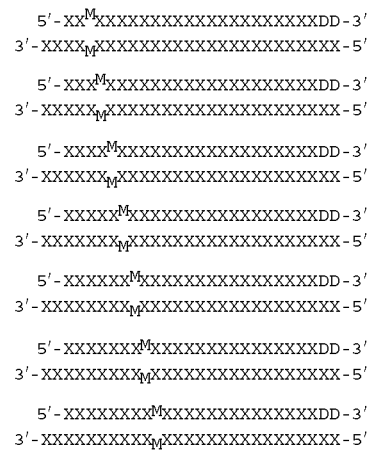

wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target MYC RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target MYC RNA (which, in certain embodiments, may be advantageous in promoting efficacy and/or potency and/or duration of effect). In certain embodiments, where mismatches occur between antisense strand and target MYC RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

```
Target RNA Sequence:        5'-...AXXXXXXXXXXXXXXXXXXXX...-3'
DsiRNAmm Sense Strand:      5'-XXXXXXXXXXXXXXXXXXXXXXXXXDD-3'
DsiRNAmm Antisense Strand:  3'-EXXXXXXXXXXXXXXXXXXXXXXXXXXX-5'

Target RNA Sequence:        5'-...XAXXXXXXXXXXXXXXXXXXX...-3'
DsiRNAmm Sense Strand:      5'-XXXXXXXXXXXXXXXXXXXXXXXXXDD-3'
DsiRNAmm Antisense Strand:  3'-XEXXXXXXXXXXXXXXXXXXXXXXXXXX-5'

Target RNA Sequence:        5'-...AXXXXXXXXXXXXXXXXXXX...-3'
DsiRNAmm Sense Strand:      5'-BXXXXXXXXXXXXXXXXXXXXXXXXDD-3'
DsiRNAmm Antisense Strand:  3'-XXEXXXXXXXXXXXXXXXXXXXXXXXXX-5'

Target RNA Sequence:        5'-...XAXXXXXXXXXXXXXXXXXXX...-3'
DsiRNAmm Sense Strand:      5'-XBXXXXXXXXXXXXXXXXXXXXXXXDD-3'
DsiRNAmm Antisense Strand:  3'-XXXEXXXXXXXXXXXXXXXXXXXXXXXX-5'

Target RNA Sequence:        5'-...XXAXXXXXXXXXXXXXXXXXX...-3'
DsiRNAmm Sense Strand:      5'-XXBXXXXXXXXXXXXXXXXXXXXXXDD-3'
DsiRNAmm Antisense Strand:  3'-XXXXEXXXXXXXXXXXXXXXXXXXXXXX-5'

Target RNA Sequence:        5'-...XXXAXXXXXXXXXXXXXXXXX...-3'
DsiRNAmm Sense Strand:      5'-XXXBXXXXXXXXXXXXXXXXXXXXXDD-3'
DsiRNAmm Antisense Strand:  3'-XXXXXEXXXXXXXXXXXXXXXXXXXXXX-5'

Target RNA Sequence:        5'-...XXXXAXXXXXXXXXXXXXXXX...-3'
DsiRNAmm Sense Strand:      5'-XXXXBXXXXXXXXXXXXXXXXXXXXDD-3'
DsiRNAmm Antisense Strand:  3'-XXXXXXEXXXXXXXXXXXXXXXXXXXXX-5'

Target RNA Sequence:        5'-...XXXXXAXXXXXXXXXXXXXXX...-3'
DsiRNAmm Sense Strand:      5'-XXXXXBXXXXXXXXXXXXXXXXXXXDD-3'
DsiRNAmm Antisense Strand:  3'-XXXXXXXEXXXXXXXXXXXXXXXXXXXX-5'

Target RNA Sequence:        5'-...XXXXXXAXXXXXXXXXXXXXX...-3'
DsiRNAmm Sense Strand:      5'-XXXXXXBXXXXXXXXXXXXXXXXXXDD-3'
DsiRNAmm Antisense Strand:  3'-XXXXXXXXEXXXXXXXXXXXXXXXXXXX-5'

Target RNA Sequence:        5'-...XXXXXXXAXXXXXXXXXXXXX...-3'
DsiRNAmm Sense Strand:      5'-XXXXXXXBXXXXXXXXXXXXXXXXXDD-3'
DsiRNAmm Antisense Strand:  3'-XXXXXXXXXEXXXXXXXXXXXXXXXXXX-5'

Target RNA Sequence:        5'-...XXXXXXXXAXXXXXXXXXXXX...-3'
DsiRNAmm Sense Strand:      5'-XXXXXXXXBXXXXXXXXXXXXXXXXDD-3'
DsiRNAmm Antisense Strand:  3'-XXXXXXXXXXEXXXXXXXXXXXXXXXXX-5'

Target RNA Sequence:        5'-...XXXXXXXXXAXXXXXXXXXXX...-3'
DsiRNAmm Sense Strand:      5'-XXXXXXXXXBXXXXXXXXXXXXXXXDD-3'
DsiRNAmm Antisense Strand:  3'-XXXXXXXXXXXEXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

In addition to the above-exemplified structures, dsRNAs of the invention can also possess one, two or three additional residues that form further mismatches with the target MYC RNA sequence. Such mismatches can be consecutive, or can be interspersed by nucleotides that form matched base pairs with the target MYC RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target MYC RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target MYC RNA sequence) of the antisense strand of a DsiRNAmm is the nucleotide residue of the antisense strand that is located immediately 3' (downstream) within the antisense strand sequence of the projected Ago2 cleavage site of the corresponding target MYC RNA sequence. In other preferred embodiments, a mismatch nucleotide of the antisense strand of a DsiRNAmm (in relation to the target MYC RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target MYC RNA sequence), mismatches can occur consecutively (e.g., at consecutive positions along the antisense strand nucleotide sequence). Alternatively, nucleotides of the antisense strand that form mismatched base pairs with the target MYC RNA sequence can be interspersed by nucleotides that base pair with the target MYC RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target MYC RNA sequence). For example, two residues of the antisense strand (located within the mismatch-tolerant region of the antisense strand) that form mismatched base pairs with the corresponding target MYC RNA sequence can occur with zero, one, two, three, four or five matched base pairs (with respect to target MYC RNA sequence) located between these mismatch-forming base pairs.

For certain dsRNAs possessing three mismatch-forming base pairs (mismatch-forming with respect to target MYC RNA sequence), mismatch-forming nucleotides can occur consecutively (e.g., in a triplet along the antisense strand nucleotide sequence). Alternatively, nucleotides of the antisense strand that form mismatched base pairs with the target MYC RNA sequence can be interspersed by nucleotides that form matched base pairs with the target MYC RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target MYC RNA). For example, three residues of the antisense strand (located within the mismatch-tolerant region of the antisense strand) that form mismatched base pairs with the corresponding target MYC RNA sequence can occur with zero, one, two, three or four matched base pairs located between any two of these mismatch-forming base pairs.

For certain dsRNAs possessing four mismatch-forming base pairs (mismatch-forming with respect to target MYC RNA sequence), mismatch-forming nucleotides can occur consecutively (e.g., in a quadruplet along the sense strand nucleotide sequence). Alternatively, nucleotides of the antisense strand that form mismatched base pairs with the target MYC RNA sequence can be interspersed by nucleotides that form matched base pairs with the target MYC RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target MYC RNA sequence—similarly, the mismatch-forming residues of antisense strand positions 19 and 21 are also interspersed by one nucleotide that forms a matched base pair with the corresponding residue of the target MYC RNA sequence). For example, four residues of the antisense strand (located within the mismatch-tolerant region of the antisense strand) that form mismatched base pairs with the corresponding target MYC RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target MYC RNA-aligned structures. Accordingly, the dsRNAs of the invention can be designed to possess in/del variations in, e.g., antisense strand sequence as compared to target MYC RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:     5'-...XXXXXXXXXXXXXXXXXXXXHXXX...-3'
DsiRNA Sense Strand:     5'-XXXXXXXXXXXXXXXXXXXXXIXDD-3'
DsiRNA Antisense Strand: 3'-XXXXXXXXXXXXXXXXXXXXXJXXX-5'

Target RNA Sequence:     5'-...XXXXXXXXXXXXXXXXXXXXHXX...-3'
DsiRNA Sense Strand:     5'-XXXXXXXXXXXXXXXXXXXXXIDD-3'
DsiRNA Antisense Strand: 3'-XXXXXXXXXXXXXXXXXXXXXJXX-5'

Target RNA Sequence:     5'-...XXXXXXXXXXXXXXXXXXXXHX...-3'
DsiRNA Sense Strand:     5'-XXXXXXXXXXXXXXXXXXXXXID-3'
DsiRNA Antisense Strand: 3'-XXXXXXXXXXXXXXXXXXXXXJX-5'
```

```
Target RNA Sequence:      5'-...XXXXXXXXXXXXXXXXXXXXXXXXXH...-3'
DsiRNA Sense Strand:      5'-XXXXXXXXXXXXXXXXXXXXXXXXXDI-3'
DsiRNA Antisense Strand:  3'-XXXXXXXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric MYC-622 DsiRNA (newly-introduced mismatch residues are italicized):

MYC-622 25/27mer DsiRNA, mismatch position=19 of sense strand (from 5'-terminus)

```
5'-AGGAACUAUGACCUCGAC^A ACGAct-3'  (SEQ ID NO: 3707)
3'-UGUCCUUGAUACUGGAGCUG_A UGCUGA-5' (SEQ ID NO: 490)
```

Optionally, the mismatched 'A' residue of position 19 of the sense strand is alternatively 'C' or 'G'.
MYC-622 25/27mer DsiRNA, mismatch position=20 of sense strand (from 5'-terminus)

```
5'-AGGAACUAUGACCUCGACU^U CGAct-3'  (SEQ ID NO: 3708)
3'-UGUCCUUGAUACUGGAGCUGA_U GCUGA-5' (SEQ ID NO: 490)
```

Optionally, the mismatched 'U' residue of position 20 of the sense strand is alternatively 'C' or 'G'.
MYC-622 25/27mer DsiRNA, mismatch position=21 of sense strand (from 5'-terminus)

```
5'-AGGAACUAUGACCUCGACU^A Gct-3'   (SEQ ID NO: 3709)
3'-UGUCCUUGAUACUGGAGCUGAU_G CUGA-5' (SEQ ID NO: 490)
```

Optionally, the mismatched 'A' residue of position 21 of the sense strand is alternatively 'U' or 'G'.
MYC-622 25/27mer DsiRNA, mismatch position=22 of sense strand (from 5'-terminus)

```
5'-AGGAACUAUGACCUCGACUAC^U Act-3'  (SEQ ID NO: 3710)
3'-UGUCCUUGAUACUGGAGCUGAUG_C UGA-5' (SEQ ID NO: 490)
```

Optionally, the mismatched 'U' residue of position 22 of the sense strand is alternatively 'A' or 'C'.
MYC-622 25/27mer DsiRNA, mismatch position=23 of sense strand (from 5'-terminus)

```
5'-AGGAACUAUGACCUCGACUACG^U ct-3'  (SEQ ID NO: 3711)
3'-UGUCCUUGAUACUGGAGCUGAUGC_U GA-5' (SEQ ID NO: 490)
```

Optionally, the mismatched 'U' residue of position 23 of the sense strand is alternatively 'C' or 'G'.
MYC-622 25/27mer DsiRNA, mismatch position=24 of sense strand (from 5'-terminus)

```
5'-AGGAACUAUGACCUCGACUACGA^t t-3'  (SEQ ID NO: 3712)
3'-UGUCCUUGAUACUGGAGCUGAUGCU_G A-5' (SEQ ID NO: 490)
```

Optionally, the mismatched 't' residue of position 24 of the sense strand is alternatively 'a' or 'g'.
MYC-622 25/27mer DsiRNA, mismatch position=25 of sense strand (from 5'-terminus)

```
5'-AGGAACUAUGACCUCGACUACGAc^a -3' (SEQ ID NO: 3713)
3'-UGUCCUUGAUACUGGAGCUGAUGCUG_A -5' (SEQ ID NO: 490)
```

Optionally, the mismatched 'a' residue of position 25 of the sense strand is alternatively 'c' or 'g'.
MYC-622 25/27mer DsiRNA, mismatch position=1 of antisense strand (from 5'-terminus)

```
5'-AGGAACUAUGACCUCGACUACGAc^t -3'  (SEQ ID NO: 163)
3'-UGUCCUUGAUACUGGAGCUGAUGCUG_U -5' (SEQ ID NO: 3714)
```

Optionally, the mismatched 'U' residue of position 1 of the antisense strand is alternatively 'G' or 'C'.
MYC-622 25/27mer DsiRNA, mismatch position=2 of antisense strand (from 5'-terminus)

```
5'-AGGAACUAUGACCUCGACUACGA^C t-3'  (SEQ ID NO: 163)
3'-UGUCCUUGAUACUGGAGCUGAUGCU_A A-5' (SEQ ID NO: 3715)
```

Optionally, the mismatched 'A' residue of position 2 of the antisense strand is alternatively 'U' or 'C'.
MYC-622 25/27mer DsiRNA, mismatch position=3 of antisense strand (from 5'-terminus)

```
5'-AGGAACUAUGACCUCGACUACG^A ct-3'  (SEQ ID NO: 163)
3'-UGUCCUUGAUACUGGAGCUGAUGC_A GA-5' (SEQ ID NO: 3716)
```

Optionally, the mismatched 'A' residue of position 3 of the antisense strand is alternatively 'C' or 'G'.
MYC-622 25/27mer DsiRNA, mismatch position=4 of antisense strand (from 5'-terminus)

```
5'-AGGAACUAUGACCUCGACUAC^G Act-3'  (SEQ ID NO: 163)
3'-UGUCCUUGAUACUGGAGCUGAUG_A UGA-5' (SEQ ID NO: 3717)
```

Optionally, the mismatched 'A' residue of position 4 of the antisense strand is alternatively 'U' or 'G'.
MYC-622 25/27mer DsiRNA, mismatch position=5 of antisense strand (from 5'-terminus)

```
5'-AGGAACUAUGACCUCGACUA^CGAct-3'    (SEQ ID NO: 163)
3'-UGUCCUUGAUACUGGAGCUGAU_UCUGA-5'  (SEQ ID NO: 3718)
```

Optionally, the mismatched 'U' residue of position 5 of the antisense strand is alternatively 'A' or 'C'.
MYC-622 25/27mer DsiRNA, mismatch position=6 of antisense strand (from 5'-terminus)

```
5'-AGGAACUAUGACCUCGACU^ACGAct-3'    (SEQ ID NO: 163)
3'-UGUCCUUGAUACUGGAGCUGA_AGCUGA-5'  (SEQ ID NO: 3719)
```

Optionally, the mismatched 'A' residue of position 6 of the antisense strand is alternatively 'C' or 'G'.
MYC-622 25/27mer DsiRNA, mismatch position=7 of antisense strand (from 5'-terminus)

```
5'-AGGAACUAUGACCUCGAC^UACGAct-3'    (SEQ ID NO: 163)
3'-UGUCCUUGAUACUGGAGCUG_UGCUGA-5'   (SEQ ID NO: 3720)
```

Optionally, the mismatched 'U' residue of position 7 of the antisense strand is alternatively 'C' or 'G'.

As another example, in the below structures, such mismatches are introduced within the asymmetric MYC-953 DsiRNA (newly-introduced mismatch residues are italicized):
MYC-953 25/27mer DsiRNA, mismatch position=19 of sense strand (from 5'-terminus)

```
5'-ACGACGAGACCUUCAUCA^UAAACat-3'    (SEQ ID NO: 3721)
3'-CCUGCUGCUCUGGAAGUAGU_UUUGUA-5'   (SEQ ID NO: 520)
```

Optionally, the mismatched 'U' residue of position 19 of the sense strand is alternatively 'C' or 'G'.
MYC-953 25/27mer DsiRNA, mismatch position=20 of sense strand (from 5'-terminus)

```
5'-ACGACGAGACCUUCAUCAA^UAACat-3'    (SEQ ID NO: 3722)
3'-CCUGCUGCUCUGGAAGUAGUU_UUGUA-5'   (SEQ ID NO: 520)
```

Optionally, the mismatched 'U' residue of position 20 of the sense strand is alternatively 'C' or 'G'.
MYC-953 25/27mer DsiRNA, mismatch position=21 of sense strand (from 5'-terminus)

```
5'-ACGACGAGACCUUCAUCAAA^UACat-3'    (SEQ ID NO: 3723)
3'-CCUGCUGCUCUGGAAGUAGUUU_UGUA-5'   (SEQ ID NO: 520)
```

Optionally, the mismatched 'U' residue of position 21 of the sense strand is alternatively 'G' or 'C'.
MYC-953 25/27mer DsiRNA, mismatch position=22 of sense strand (from 5'-terminus)

```
5'-ACGACGAGACCUUCAUCAAAA^GCat-3'    (SEQ ID NO: 3724)
3'-CCUGCUGCUCUGGAAGUAGUUUU_GGUA-5'  (SEQ ID NO: 520)
```

Optionally, the mismatched 'G' residue of position 22 of the sense strand is alternatively 'U' or 'C'.
MYC-953 25/27mer DsiRNA, mismatch position=23 of sense strand (from 5'-terminus)

```
5'-ACGACGAGACCUUCAUCAAAAA^Aat-3'    (SEQ ID NO: 3725)
3'-CCUGCUGCUCUGGAAGUAGUUUUU_GUA-5'  (SEQ ID NO: 3725)
```

Optionally, the mismatched 'A' residue of position 23 of the sense strand is alternatively 'U' or 'G'.
MYC-953 25/27mer DsiRNA, mismatch position=24 of sense strand (from 5'-terminus)

```
5'-ACGACGAGACCUUCAUCAAAAAC^gt-3'    (SEQ ID NO: 3726)
3'-CCUGCUGCUCUGGAAGUAGUUUUUG_UA-5'  (SEQ ID NO: 520)
```

Optionally, the mismatched 'g' residue of position 24 of the sense strand is alternatively 't' or 'c'.
MYC-953 25/27mer DsiRNA, mismatch position=25 of sense strand (from 5'-terminus)

```
5'-ACGACGAGACCUUCAUCAAAAACa^a-3'    (SEQ ID NO: 3727)
3'-CCUGCUGCUCUGGAAGUAGUUUUUGU_A-5'  (SEQ ID NO: 520)
```

Optionally, the mismatched 'a' residue of position 25 of the sense strand is alternatively 'c' or 'g'.
MYC-953 25/27mer DsiRNA, mismatch position=1 of antisense strand (from 5'-terminus)

```
5'-ACGACGAGACCUUCAUCAAAAACa^t-3'    (SEQ ID NO: 193)
3'-CCUGCUGCUCUGGAAGUAGUUUUUGU_U-5'  (SEQ ID NO: 3728)
```

Optionally, the mismatched 'U' residue of position 1 of the antisense strand is alternatively 'G' or 'C'.
MYC-953 25/27mer DsiRNA, mismatch position=2 of antisense strand (from 5'-terminus)

```
5'-ACGACGAGACCUUCAUCAAAAAC^at-3'    (SEQ ID NO: 193)
3'-CCUGCUGCUCUGGAAGUAGUUUUUG_CA-5'  (SEQ ID NO: 3729)
```

Optionally, the mismatched 'C' residue of position 2 of the antisense strand is alternatively 'A' or 'G'.
MYC-953 25/27mer DsiRNA, mismatch position=3 of antisense strand (from 5'-terminus)

```
5'-ACGACGAGACCUUCAUCAAAAA^Cat-3'    (SEQ ID NO: 193)
3'-CCUGCUGCUCUGGAAGUAGUUUUU_UA-5'   (SEQ ID NO: 3730)
```

Optionally, the mismatched 'U' residue of position 3 of the antisense strand is alternatively 'A' or 'C'.
MYC-953 25/27mer DsiRNA, mismatch position=4 of antisense strand (from 5'-terminus)

```
5'-ACGACGAGACCUUCAUCAAAᴬCat-3'    (SEQ ID NO: 193)
3'-CCUGCUGCUCUGGAAGUAGUUUU_CGUA-5' (SEQ ID NO: 3731)
```

Optionally, the mismatched 'C' residue of position 4 of the antisense strand is alternatively 'A' or 'G'.
MYC-953 25/27mer DsiRNA, mismatch position=5 of antisense strand (from 5'-terminus)

```
5'-ACGACGAGACCUUCAUCAAAᴬACat-3'   (SEQ ID NO: 193)
3'-CCUGCUGCUCUGGAAGUAGUUU_AUGUA-5' (SEQ ID NO: 3732)
```

Optionally, the mismatched 'A' residue of position 5 of the antisense strand is alternatively 'C' or 'G'.
MYC-953 25/27mer DsiRNA, mismatch position=6 of antisense strand (from 5'-terminus)

```
5'-ACGACGAGACCUUCAUCAAᴬAACat-3'   (SEQ ID NO: 193)
3'-CCUGCUGCUCUGGAAGUAGUU_AUUGUA-5' (SEQ ID NO: 3733)
```

Optionally, the mismatched 'A' residue of position 6 of the antisense strand is alternatively 'C' or 'G'.
MYC-953 25/27mer DsiRNA, mismatch position=7 of antisense strand (from 5'-terminus)

```
5'-ACGACGAGACCUUCAUCᴬAAACat-3'    (SEQ ID NO: 193)
3'-CCUGCUGCUCUGGAAGUAGU_AUUUGUA-5' (SEQ ID NO: 3734)
```

Optionally, the mismatched 'A' residue of position 7 of the antisense strand is alternatively 'C' or 'G'.
As an additional example, in the below structures, such mismatches are introduced within the asymmetric MYC-1364 DsiRNA (newly-introduced mismatch residues are italicized):
MYC-1364 25/27mer DsiRNA, mismatch position=19 of sense strand (from 5'-terminus)

```
5'-AAGAUGAGGAAGAAAUCGᵁUGUUgt-3'   (SEQ ID NO: 3735)
3'-UCUUCUACUCCUUCUUUAGC_UACAACA-5' (SEQ ID NO: 361)
```

Optionally, the mismatched 'U' residue of position 19 of the sense strand is alternatively 'C' or 'G'.
MYC-1364 25/27mer DsiRNA, mismatch position=20 of sense strand (from 5'-terminus)

```
5'-AAGAUGAGGAAGAAAUCGAᴬGUUgt-3'   (SEQ ID NO: 3736)
3'-UCUUCUACUCCUUCUUUAGCU_ACAACA-5' (SEQ ID NO: 361)
```

Optionally, the mismatched 'A' residue of position 20 of the sense strand is alternatively 'C' or 'G'.
MYC-1364 25/27mer DsiRNA, mismatch position=21 of sense strand (from 5'-terminus)

```
5'-AAGAUGAGGAAGAAAUCGAUᴬUUgt-3'   (SEQ ID NO: 3737)
3'-UCUUCUACUCCUUCUUUAGCUA_CAACA-5' (SEQ ID NO: 361)
```

Optionally, the mismatched 'A' residue of position 21 of the sense strand is alternatively 'U' or 'C'.
MYC-1364 25/27mer DsiRNA, mismatch position=22 of sense strand (from 5'-terminus)

```
5'-AAGAUGAGGAAGAAAUCGAUGᴳUgt-3'   (SEQ ID NO: 3738)
3'-UCUUCUACUCCUUCUUUAGCUAC_AACA-5' (SEQ ID NO: 361)
```

Optionally, the mismatched 'G' residue of position 22 of the sense strand is alternatively 'A' or 'C'.
MYC-1364 25/27mer DsiRNA, mismatch position=23 of sense strand (from 5'-terminus)

```
5'-AAGAUGAGGAAGAAAUCGAUGUᴬgt-3'   (SEQ ID NO: 3739)
3'-UCUUCUACUCCUUCUUUAGCUACA_ACA-5' (SEQ ID NO: 361)
```

Optionally, the mismatched 'A' residue of position 23 of the sense strand is alternatively 'C' or 'G'.
MYC-1364 25/27mer DsiRNA, mismatch position=24 of sense strand (from 5'-terminus)

```
5'-AAGAUGAGGAAGAAAUCGAUGUUᵗt-3'   (SEQ ID NO: 3740)
3'-UCUUCUACUCCUUCUUUAGCUACAA_CA-5' (SEQ ID NO: 361)
```

Optionally, the mismatched 't' residue of position 24 of the sense strand is alternatively 'a' or 'c'.
MYC-1364 25/27mer DsiRNA, mismatch position=25 of sense strand (from 5'-terminus)

```
5'-AAGAUGAGGAAGAAAUCGAUGUUgᵃ-3'   (SEQ ID NO: 3741)
3'-UCUUCUACUCCUUCUUUAGCUACAAC_A-5' (SEQ ID NO: 361)
```

Optionally, the mismatched 'a' residue of position 25 of the sense strand is alternatively 'c' or 'g'.
MYC-1364 25/27mer DsiRNA, mismatch position=1 of antisense strand (from 5'-terminus)

```
5'-AAGAUGAGGAAGAAAUCGAUGUUgᵗ-3'   (SEQ ID NO: 34)
3'-UCUUCUACUCCUUCUUUAGCUACAAC_U-5' (SEQ ID NO: 3742)
```

Optionally, the mismatched 'U' residue of position 1 of the antisense strand is alternatively 'G' or 'C'.
MYC-1364 25/27mer DsiRNA, mismatch position=2 of antisense strand (from 5'-terminus)

```
5'-AAGAUGAGGAAGAAAUCGAUGUUᵍt-3'   (SEQ ID NO: 34)
3'-UCUUCUACUCCUUCUUUAGCUACAA_AA-5' (SEQ ID NO: 3743)
```

Optionally, the mismatched 'A' residue of position 2 of the antisense strand is alternatively 'U' or 'G'.
MYC-1364 25/27mer DsiRNA, mismatch position=3 of antisense strand (from 5'-terminus)

```
5'-AAGAUGAGGAAGAAAUCGAUGUᵁgt-3'   (SEQ ID NO: 34)
3'-UCUUCUACUCCUUCUUUAGCUACA_UCA-5' (SEQ ID NO: 3744)
```

Optionally, the mismatched 'U' residue of position 3 of the antisense strand is alternatively 'C' or 'G'.

MYC-1364 25/27mer DsiRNA, mismatch position=4 of antisense strand (from 5'-terminus)

```
5'-AAGAUGAGGAAGAAAUCGAUG^UUgt-3'     (SEQ ID NO: 34)
3'-UCUUCUACUCCUUCUUUAGCUAC_CACA-5'   (SEQ ID NO: 3745)
```

Optionally, the mismatched 'C' residue of position 4 of the antisense strand is alternatively 'U' or 'G'.

MYC-1364 25/27mer DsiRNA, mismatch position=5 of antisense strand (from 5'-terminus)

```
5'-AAGAUGAGGAAGAAAUCGAU^GUUgt-3'     (SEQ ID NO: 34)
3'-UCUUCUACUCCUUCUUUAGCUA_UAACA-5'   (SEQ ID NO: 3746)
```

Optionally, the mismatched 'U' residue of position 5 of the antisense strand is alternatively 'A' or 'G'.

MYC-1364 25/27mer DsiRNA, mismatch position=6 of antisense strand (from 5'-terminus)

```
5'-AAGAUGAGGAAGAAAUCGA^UGUUgt-3'     (SEQ ID NO: 34)
3'-UCUUCUACUCCUUCUUUAGCU_UCAACA-5'   (SEQ ID NO: 3747)
```

Optionally, the mismatched 'U' residue of position 6 of the antisense strand is alternatively 'C' or 'G'.

MYC-1364 25/27mer DsiRNA, mismatch position=7 of antisense strand (from 5'-terminus)

```
5'-AAGAUGAGGAAGAAAUCG^AUGUUgt-3'     (SEQ ID NO: 34)
3'-UCUUCUACUCCUUCUUUAGC_AACAACA-5'   (SEQ ID NO: 3748)
```

Optionally, the mismatched 'A' residue of position 7 of the antisense strand is alternatively 'C' or 'G'.

As a further example, in the below structures, such mismatches are introduced within the asymmetric MYC-1370 DsiRNA (newly-introduced mismatch residues are italicized):

MYC-1370 25/27mer DsiRNA, mismatch position=19 of sense strand (from 5'-terminus)

```
5'-AGGAAGAAAUCGAUGUUG^AUUCUgt-3'     (SEQ ID NO: 3749)
3'-ACUCCUUCUUUAGCUACAAC_AAGACA-5'    (SEQ ID NO: 362)
```

Optionally, the mismatched 'A' residue of position 19 of the sense strand is alternatively 'C' or 'G'.

MYC-1370 25/27mer DsiRNA, mismatch position=20 of sense strand (from 5'-terminus)

```
5'-AGGAAGAAAUCGAUGUUGU^AUCUgt-3'     (SEQ ID NO: 3750)
3'-ACUCCUUCUUUAGCUACAACA_AGACA-5'    (SEQ ID NO: 362)
```

Optionally, the mismatched 'A' residue of position 20 of the sense strand is alternatively 'C' or 'G'.

MYC-1370 25/27mer DsiRNA, mismatch position=21 of sense strand (from 5'-terminus)

```
5'-AGGAAGAAAUCGAUGUUGUU^ACUgt-3'     (SEQ ID NO: 3751)
3'-ACUCCUUCUUUAGCUACAACAA_AGACA-5'   (SEQ ID NO: 362)
```

Optionally, the mismatched 'A' residue of position 21 of the sense strand is alternatively 'C' or 'G'.

MYC-1370 25/27mer DsiRNA, mismatch position=22 of sense strand (from 5'-terminus)

```
5'-AGGAAGAAAUCGAUGUUGUUU^Ugt-3'      (SEQ ID NO: 3752)
3'-ACUCCUUCUUUAGCUACAACAAA_GACA-5'   (SEQ ID NO: 362)
```

Optionally, the mismatched 'U' residue of position 22 of the sense strand is alternatively 'A' or 'G'.

MYC-1370 25/27mer DsiRNA, mismatch position=23 of sense strand (from 5'-terminus)

```
5'-AGGAAGAAAUCGAUGUUGUUUC^Agt-3'     (SEQ ID NO: 3753)
3'-ACUCCUUCUUUAGCUACAACAAAG_ACA-5'   (SEQ ID NO: 362)
```

Optionally, the mismatched 'A' residue of position 23 of the sense strand is alternatively 'C' or 'G'.

MYC-1370 25/27mer DsiRNA, mismatch position=24 of sense strand (from 5'-terminus)

```
5'-AGGAAGAAAUCGAUGUUGUUUCU^t-3'      (SEQ ID NO: 3754)
3'-ACUCCUUCUUUAGCUACAACAAAGA_CA-5'   (SEQ ID NO: 362)
```

Optionally, the mismatched 't' residue of position 24 of the sense strand is alternatively 'a' or 'c'.

MYC-1370 25/27mer DsiRNA, mismatch position=25 of sense strand (from 5'-terminus)

```
5'-AGGAAGAAAUCGAUGUUGUUUCUg^a-3'     (SEQ ID NO: 3755)
3'-ACUCCUUCUUUAGCUACAACAAAGAC_A-5'   (SEQ ID NO: 362)
```

Optionally, the mismatched 'a' residue of position 25 of the sense strand is alternatively 'c' or 'g'.

MYC-1370 25/27mer DsiRNA, mismatch position=1 of antisense strand (from 5'-terminus)

```
5'-AGGAAGAAAUCGAUGUUGUUUCUg^t-3'     (SEQ ID NO: 35)
3'-ACUCCUUCUUUAGCUACAACAAAGAC_U-5'   (SEQ ID NO: 3756)
```

Optionally, the mismatched 'U' residue of position 1 of the antisense strand is alternatively 'G' or 'C'.

MYC-1370 25/27mer DsiRNA, mismatch position=2 of antisense strand (from 5'-terminus)

```
5'-AGGAAGAAAUCGAUGUUGUUUCU^gt-3'     (SEQ ID NO: 35)
3'-ACUCCUUCUUUAGCUACAACAAAGA_AA-5'   (SEQ ID NO: 3757)
```

Optionally, the mismatched 'A' residue of position 2 of the antisense strand is alternatively 'U' or 'G'.

MYC-1370 25/27mer DsiRNA, mismatch position=3 of antisense strand (from 5'-terminus)

```
5'-AGGAAGAAAUCGAUGUUGUUUC^Ugt-3'  (SEQ ID NO: 35)
3'-BACUCCUUCUUUAGCUACAACAAAG_UCA-5'  (SEQ ID NO: 3758)
```

Optionally, the mismatched 'U' residue of position 3 of the antisense strand is alternatively 'C' or 'G'.
MYC-1370 25/27mer DsiRNA, mismatch position=4 of antisense strand (from 5'-terminus)

```
5'-AGGAAGAAAUCGAUGUUGUUU^Cugt-3'  (SEQ ID NO: 35)
3'-ACUCCUUCUUUAGCUACAACAAA_AACA-5'  (SEQ ID NO: 3759)
```

Optionally, the mismatched 'A' residue of position 4 of the antisense strand is alternatively 'U' or 'C'.
MYC-1370 25/27mer DsiRNA, mismatch position=5 of antisense strand (from 5'-terminus)

```
5'-AGGAAGAAAUCGAUGUUGUU^UCugt-3'  (SEQ ID NO: 35)
3'-ACUCCUUCUUUAGCUACAACAA_UGACA-5'  (SEQ ID NO: 3760)
```

Optionally, the mismatched 'U' residue of position 5 of the antisense strand is alternatively 'C' or 'G'.
MYC-1370 25/27mer DsiRNA, mismatch position=6 of antisense strand (from 5'-terminus)

```
5'-AGGAAGAAAUCGAUGUUGU^UUCugt-3'  (SEQ ID NO: 35)
3'-ACUCCUUCUUUAGCUACAACA_UAGACA-5'  (SEQ ID NO: 3761)
```

Optionally, the mismatched 'U' residue of position 6 of the antisense strand is alternatively 'C' or 'G'.
MYC-1370 25/27mer DsiRNA, mismatch position=7 of antisense strand (from 5'-terminus)

```
5'-AGGAAGAAAUCGAUGUUG^UUUCugt-3'  (SEQ ID NO: 35)
3'-ACUCCUUCUUUAGCUACAAC_UAAGACA-5'  (SEQ ID NO: 3762)
```

Optionally, the mismatched 'U' residue of position 7 of the antisense strand is alternatively 'C' or 'G'.
As another example, in the below structures, such mismatches are introduced within the asymmetric MYC-1711 DsiRNA (newly-introduced mismatch residues are italicized):
MYC-1711 25/27mer DsiRNA, mismatch position=19 of sense strand (from 5'-terminus)

```
5'-AGCUUUUUUGCCCUGCGU^AACAga-3'  (SEQ ID NO: 3763)
3'-CCUCGAAAAACGGGACGCA_CUGGUCU-5'  (SEQ ID NO: 606)
```

Optionally, the mismatched 'A' residue of position 19 of the sense strand is alternatively 'U' or 'C'.
MYC-1711 25/27mer DsiRNA, mismatch position=20 of sense strand (from 5'-terminus)

```
5'-AGCUUUUUUGCCCUGCGUG^UCCAga-3'  (SEQ ID NO: 3764)
3'-CCUCGAAAAACGGGACGCAC_UGGUCU-5'  (SEQ ID NO: 606)
```

Optionally, the mismatched 'U' residue of position 20 of the sense strand is alternatively 'C' or 'G'.
MYC-1711 25/27mer DsiRNA, mismatch position=21 of sense strand (from 5'-terminus)

```
5'-AGCUUUUUUGCCCUGCGUGA^ACAga-3'  (SEQ ID NO: 3765)
3'-CCUCGAAAAACGGGACGCACU_GGUCU-5'  (SEQ ID NO: 606)
```

Optionally, the mismatched 'A' residue of position 21 of the sense strand is alternatively 'U' or 'G'.
MYC-1711 25/27mer DsiRNA, mismatch position=22 of sense strand (from 5'-terminus)

```
5'-AGCUUUUUUGCCCUGCGUGA^UAga-3'  (SEQ ID NO: 3766)
3'-CCUCGAAAAACGGGACGCACU_GUCU-5'  (SEQ ID NO: 606)
```

Optionally, the mismatched 'U' residue of position 22 of the sense strand is alternatively 'A' or 'G'.
MYC-1711 25/27mer DsiRNA, mismatch position=23 of sense strand (from 5'-terminus)

```
5'-AGCUUUUUUGCCCUGCGUGACC^Uga-3'  (SEQ ID NO: 3767)
3'-CCUCGAAAAACGGGACGCACUGG_UCU-5'  (SEQ ID NO: 606)
```

Optionally, the mismatched 'U' residue of position 23 of the sense strand is alternatively 'C' or 'G'.
MYC-1711 25/27mer DsiRNA, mismatch position=24 of sense strand (from 5'-terminus)

```
5'-AGCUUUUUUGCCCUGCGUGACCA^ta-3'  (SEQ ID NO: 3768)
3'-CCUCGAAAAACGGGACGCACUGGU_CU-5'  (SEQ ID NO: 606)
```

Optionally, the mismatched 't' residue of position 24 of the sense strand is alternatively 'a' or 'c'.
MYC-1711 25/27mer DsiRNA, mismatch position=25 of sense strand (from 5'-terminus)

```
5'-AGCUUUUUUGCCCUGCGUGACCAg^t-3'  (SEQ ID NO: 3769)
3'-CCUCGAAAAACGGGACGCACUGGUC_U-5'  (SEQ ID NO: 606)
```

Optionally, the mismatched 't' residue of position 25 of the sense strand is alternatively 'c' or 'g'.
MYC-1711 25/27mer DsiRNA, mismatch position=1 of antisense strand (from 5'-terminus)

```
5'-AGCUUUUUUGCCCUGCGUGACCAg^a-3'  (SEQ ID NO: 279)
3'-CCUCGAAAAACGGGACGCACUGGUC_A-5'  (SEQ ID NO: 3770)
```

Optionally, the mismatched 'A' residue of position 1 of the antisense strand is alternatively 'G' or 'C'.
MYC-1711 25/27mer DsiRNA, mismatch position=2 of antisense strand (from 5'-terminus)

```
5'-AGCUUUUUUGCCCUGCGUGACCA^ga-3'  (SEQ ID NO: 279)
3'-CCUCGAAAAACGGGACGCACUGGU_AU-5'  (SEQ ID NO: 3771)
```

Optionally, the mismatched 'A' residue of position 2 of the antisense strand is alternatively 'U' or 'G'.

MYC-1711 25/27mer DsiRNA, mismatch position=3 of antisense strand (from 5'-terminus)

```
5'-AGCUUUUUUGCCCUGCGUGACC^Aga-3'   (SEQ ID NO: 279)
3'-CCUCGAAAAAACGGGACGCACUGG_ACU-5' (SEQ ID NO: 3772)
```

Optionally, the mismatched 'A' residue of position 3 of the antisense strand is alternatively 'C' or 'G'.

MYC-1711 25/27mer DsiRNA, mismatch position=4 of antisense strand (from 5'-terminus)

```
5'-AGCUUUUUUGCCCUGCGUGAC^CAga-3'   (SEQ ID NO: 279)
3'-CCUCGAAAAAACGGGACGCACUG_AUCU-5' (SEQ ID NO: 3773)
```

Optionally, the mismatched 'A' residue of position 4 of the antisense strand is alternatively 'U' or 'C'.

MYC-1711 25/27mer DsiRNA, mismatch position=5 of antisense strand (from 5'-terminus)

Optionally, the mismatched 'U' residue of position 5 of the antisense strand is alternatively 'A' or 'C'.

MYC-1711 25/27mer DsiRNA, mismatch position=6 of antisense strand (from 5'-terminus)

```
5'-AGCUUUUUUGCCCUGCGUGA^CCAga-3'   (SEQ ID NO: 279)
3'-CCUCGAAAAAACGGGACGCACU_UGUCU-5' (SEQ ID NO: 3774)
```

Optionally, the mismatched 'A' residue of position 6 of the antisense strand is alternatively 'C' or 'G'.

MYC-1711 25/27mer DsiRNA, mismatch position=7 of antisense strand (from 5'-terminus)

```
5'-AGCUUUUUUGCCCUGCGUG^ACCAga-3'   (SEQ ID NO: 279)
3'-CCUCGAAAAAACGGGACGCAC_AGGUCU-5' (SEQ ID NO: 3775)
```

Optionally, the mismatched 'U' residue of position 7 of the antisense strand is alternatively 'A' or 'G'.

As an additional example, in the below structures, such mismatches are introduced within the asymmetric MYC-1769 DsiRNA (newly-introduced mismatch residues are italicized):

MYC-1769 25/27mer DsiRNA, mismatch position=19 of sense strand (from 5'-terminus)

```
5'-AGCUUUUUUGCCCUGCGU^GACCAga-3'   (SEQ ID NO: 279)
3'-CCUCGAAAAAACGGGACGCA_UUGGUCU-5' (SEQ ID NO: 3776)
```

Optionally, the mismatched 'U' residue of position 19 of the sense strand is alternatively 'C' or 'G'.

MYC-1769 25/27mer DsiRNA, mismatch position=20 of sense strand (from 5'-terminus)

```
5'-AGGUAGUUAUCCUUAAAA^UAGCCac-3'   (SEQ ID NO: 3777)
3'-GUUCCAUCAAUAGGAAUUUU_UUCGGUG-5' (SEQ ID NO: 393)
```

```
5'-AGGUAGUUAUCCUUAAAAA^UGCCac-3'   (SEQ ID NO: 3778)
3'-GUUCCAUCAAUAGGAAUUUUU_UCGGUG-5' (SEQ ID NO: 393)
```

Optionally, the mismatched 'U' residue of position 20 of the sense strand is alternatively 'C' or 'G'.

MYC-1769 25/27mer DsiRNA, mismatch position=21 of sense strand (from 5'-terminus)

```
5'-AGGUAGUUAUCCUUAAAAAA^ACCac-3'   (SEQ ID NO: 3779)
3'-GUUCCAUCAAUAGGAAUUUUUU_CGGUG-5' (SEQ ID NO: 393)
```

Optionally, the mismatched 'A' residue of position 21 of the sense strand is alternatively 'U' or 'C'.

MYC-1769 25/27mer DsiRNA, mismatch position=22 of sense strand (from 5'-terminus)

```
5'-AGGUAGUUAUCCUUAAAAAAG^UCac-3'   (SEQ ID NO: 3780)
3'-GUUCCAUCAAUAGGAAUUUUUUC_GGUG-5' (SEQ ID NO: 393)
```

Optionally, the mismatched 'U' residue of position 22 of the sense strand is alternatively 'A' or 'G'.

MYC-1769 25/27mer DsiRNA, mismatch position=23 of sense strand (from 5'-terminus)

```
5'-AGGUAGUUAUCCUUAAAAAAGC^Aac-3'   (SEQ ID NO: 3781)
3'-GUUCCAUCAAUAGGAAUUUUUUCG_UG-5'  (SEQ ID NO: 393)
```

Optionally, the mismatched 'A' residue of position 23 of the sense strand is alternatively 'U' or 'G'.

MYC-1769 25/27mer DsiRNA, mismatch position=24 of sense strand (from 5'-terminus)

```
5'-AGGUAGUUAUCCUUAAAAAAGCC^gc-3'   (SEQ ID NO: 3782)
3'-GUUCCAUCAAUAGGAAUUUUUUCGG_UG-5' (SEQ ID NO: 393)
```

Optionally, the mismatched 'g' residue of position 24 of the sense strand is alternatively 't' or 'c'.

MYC-1769 25/27mer DsiRNA, mismatch position=25 of sense strand (from 5'-terminus)

```
5'-AGGUAGUUAUCCUUAAAAAAGCC^a-3'    (SEQ ID NO: 3783)
3'-GUUCCAUCAAUAGGAAUUUUUUCGGU_G-5' (SEQ ID NO: 393)
```

Optionally, the mismatched 'a' residue of position 25 of the sense strand is alternatively 't' or 'g'.

MYC-1769 25/27mer DsiRNA, mismatch position=1 of antisense strand (from 5'-terminus)

```
5'-AGGUAGUUAUCCUUAAAAAAGCCa^c-3'   (SEQ ID NO: 66)
3'-GUUCCAUCAAUAGGAAUUUUUUCGGU_U-5' (SEQ ID NO: 3784)
```

Optionally, the mismatched 'U' residue of position 1 of the antisense strand is alternatively 'A' or 'C'.

MYC-1769 25/27mer DsiRNA, mismatch position=2 of antisense strand (from 5'-terminus)

```
5'-AGGUAGUUAUCCUUAAAAAAGCCᵃc-3' (SEQ ID NO: 66)
3'-GUUCCAUCAAUAGGAAUUUUUUCGG_CG-5' (SEQ ID NO: 3785)
```

Optionally, the mismatched 'C' residue of position 2 of the antisense strand is alternatively 'A' or 'G'.
MYC-1769 25/27mer DsiRNA, mismatch position=3 of antisense strand (from 5'-terminus)

```
5'-AGGUAGUUAUCCUUAAAAAAGCᶜac-3' (SEQ ID NO: 66)
3'-GUUCCAUCAAUAGGAAUUUUUUCG_UUG-5' (SEQ ID NO: 3786)
```

Optionally, the mismatched 'U' residue of position 3 of the antisense strand is alternatively 'A' or 'C'.
MYC-1769 25/27mer DsiRNA, mismatch position=4 of antisense strand (from 5'-terminus)

```
5'-AGGUAGUUAUCCUUAAAAAAGᶜCac-3' (SEQ ID NO: 66)
3'-GUUCCAUCAAUAGGAAUUUUUUC_AGUG-5' (SEQ ID NO: 3787)
```

Optionally, the mismatched 'A' residue of position 4 of the antisense strand is alternatively 'U' or 'C'.
MYC-1769 25/27mer DsiRNA, mismatch position=5 of antisense strand (from 5'-terminus)

```
5'-AGGUAGUUAUCCUUAAAAAᴳCCac-3' (SEQ ID NO: 66)
3'-GUUCCAUCAAUAGGAAUUUUU_UGGUG-5' (SEQ ID NO: 3788)
```

Optionally, the mismatched 'U' residue of position 5 of the antisense strand is alternatively 'A' or 'G'.
MYC-1769 25/27mer DsiRNA, mismatch position=6 of antisense strand (from 5'-terminus)

```
5'-AGGUAGUUAUCCUUAAAAᴬGCCac-3' (SEQ ID NO: 66)
3'-GUUCCAUCAAUAGGAAUUUUU_ACGGUG-5' (SEQ ID NO: 3789)
```

Optionally, the mismatched 'A' residue of position 6 of the antisense strand is alternatively 'C' or 'G'.
MYC-1769 25/27mer DsiRNA, mismatch position=7 of antisense strand (from 5'-terminus)

```
5'-AGGUAGUUAUCCUUAAAAᴬAGCCac-3' (SEQ ID NO: 66)
3'-GUUCCAUCAAUAGGAAUUUU_AUCGGUG-5' (SEQ ID NO: 3790)
```

Optionally, the mismatched 'A' residue of position 7 of the antisense strand is alternatively 'C' or 'G'.
As a further example, in the below structures, such mismatches are introduced within the asymmetric MYC-1965 DsiRNA (newly-introduced mismatch residues are italicized):
MYC-1965 25/27mer DsiRNA, mismatch position=19 of sense strand (from 5'-terminus)

```
5'-CCUAUGAACUUGUUUCAAᵁUGCAtg-3' (SEQ ID NO: 3791)
3'-GUGGAUACUUGAACAAAGUU_UACGUAC-5' (SEQ ID NO: 422)
```

Optionally, the mismatched 'U' residue of position 19 of the sense strand is alternatively 'C' or 'G'.
MYC-1965 25/27mer DsiRNA, mismatch position=20 of sense strand (from 5'-terminus)

```
5'-CCUAUGAACUUGUUUCAAAᴬGCAtg-3' (SEQ ID NO: 3792)
3'-GUGGAUACUUGAACAAAGUUU_ACGUAC-5' (SEQ ID NO: 422)
```

Optionally, the mismatched 'A' residue of position 20 of the sense strand is alternatively 'C' or 'G'.
MYC-1965 25/27mer DsiRNA, mismatch position=21 of sense strand (from 5'-terminus)

```
5'-CCUAUGAACUUGUUUCAAAUᴬCAtg-3' (SEQ ID NO: 3793)
3'-GUGGAUACUUGAACAAAGUUA_CGUAC-5' (SEQ ID NO: 422)
```

Optionally, the mismatched 'A' residue of position 21 of the sense strand is alternatively 'U' or 'C'.
MYC-1965 25/27mer DsiRNA, mismatch position=22 of sense strand (from 5'-terminus)

```
5'-CCUAUGAACUUGUUUCAAAUGᵁAtg-3' (SEQ ID NO: 3794)
3'-GUGGAUACUUGAACAAAGUUAC_GUAC-5' (SEQ ID NO: 422)
```

Optionally, the mismatched 'U' residue of position 22 of the sense strand is alternatively 'A' or 'G'.
MYC-1965 25/27mer DsiRNA, mismatch position=23 of sense strand (from 5'-terminus)

```
5'-CCUAUGAACUUGUUUCAAAUGCᵁtg-3' (SEQ ID NO: 3795)
3'-GUGGAUACUUGAACAAAGUUACG_UAC-5' (SEQ ID NO: 422)
```

Optionally, the mismatched 'U' residue of position 23 of the sense strand is alternatively 'C' or 'G'.
MYC-1965 25/27mer DsiRNA, mismatch position=24 of sense strand (from 5'-terminus)

```
5'-CCUAUGAACUUGUUUCAAAUGCAᵍg-3' (SEQ ID NO: 3796)
3'-GUGGAUACUUGAACAAAGUUACGU_AC-5' (SEQ ID NO: 422)
```

Optionally, the mismatched 'g' residue of position 24 of the sense strand is alternatively 'a' or 'c'.
MYC-1965 25/27mer DsiRNA, mismatch position=25 of sense strand (from 5'-terminus)

```
5'-CCUAUGAACUUGUUUCAAAUGCAtᵃ-3' (SEQ ID NO: 3797)
3'-GUGGAUACUUGAACAAAGUUACGUA_C-5' (SEQ ID NO: 422)
```

Optionally, the mismatched 'a' residue of position 25 of the sense strand is alternatively 't' or 'c'.
MYC-1965 25/27mer DsiRNA, mismatch position=1 of antisense strand (from 5'-terminus)

```
5'-CCUAUGAACUUGUUUCAAAUGCAt^g-3' (SEQ ID NO: 95)
3'-GUGGAUACUUGAACAAAGUUUACGUA_U-5' (SEQ ID NO: 3798)
```

Optionally, the mismatched 'U' residue of position 1 of the antisense strand is alternatively 'A' or 'G'.
MYC-1965 25/27mer DsiRNA, mismatch position=2 of antisense strand (from 5'-terminus)

```
5'-CCUAUGAACUUGUUUCAAAUGCA^tg-3' (SEQ ID NO: 95)
3'-GUGGAUACUUGAACAAAGUUUACGU_CC-5' (SEQ ID NO: 3799)
```

Optionally, the mismatched 'C' residue of position 2 of the antisense strand is alternatively 'U' or 'G'.
MYC-1965 25/27mer DsiRNA, mismatch position=3 of antisense strand (from 5'-terminus)

```
5'-CCUAUGAACUUGUUUCAAAUGC^Atg-3' (SEQ ID NO: 95)
3'-GUGGAUACUUGAACAAAGUUUACG_AAC-5' (SEQ ID NO: 3800)
```

Optionally, the mismatched 'A' residue of position 3 of the antisense strand is alternatively 'C' or 'G'.
MYC-1965 25/27mer DsiRNA, mismatch position=4 of antisense strand (from 5'-terminus)

```
5'-CCUAUGAACUUGUUUCAAAUG^CAtg-3' (SEQ ID NO: 95)
3'-GUGGAUACUUGAACAAAGUUUAC_AUAC-5' (SEQ ID NO: 3801)
```

Optionally, the mismatched 'A' residue of position 4 of the antisense strand is alternatively 'U' or 'C'.
MYC-1965 25/27mer DsiRNA, mismatch position=5 of antisense strand (from 5'-terminus)

```
5'-CCUAUGAACUUGUUUCAAAU^GCAtg-3' (SEQ ID NO: 95)
3'-GUGGAUACUUGAACAAAGUUUA_UGUAC-5' (SEQ ID NO: 3802)
```

Optionally, the mismatched 'U' residue of position 5 of the antisense strand is alternatively 'A' or 'G'.
MYC-1965 25/27mer DsiRNA, mismatch position=6 of antisense strand (from 5'-terminus)

```
5'-CCUAUGAACUUGUUUCAAA^UGCAtg-3' (SEQ ID NO: 95)
3'-GUGGAUACUUGAACAAAGUUU_UCGUAC-5' (SEQ ID NO: 3803)
```

Optionally, the mismatched 'U' residue of position 6 of the antisense strand is alternatively 'C' or 'G'.
MYC-1965 25/27mer DsiRNA, mismatch position=7 of antisense strand (from 5'-terminus)

```
5'-CCUAUGAACUUGUUUCAA^AUGCAtg-3' (SEQ ID NO: 95)
3'-GUGGAUACUUGAACAAAGUU_AACGUAC-5' (SEQ ID NO: 3804)
```

Optionally, the mismatched 'A' residue of position 7 of the antisense strand is alternatively 'C' or 'G'.
As another example, in the below structures, such mismatches are introduced within the asymmetric MYC-2099 DsiRNA (newly-introduced mismatch residues are italicized):

MYC-2099 25/27mer DsiRNA, mismatch position=19 of sense strand (from 5'-terminus)

```
5'-CCAUCUUUUUUUUUCUU^AAACAga-3' (SEQ ID NO: 3805)
3'-AUGGUAGAAAAAAAAAAGAA_AUUGUCU-5' (SEQ ID NO: 444)
```

Optionally, the mismatched 'A' residue of position 19 of the sense strand is alternatively 'C' or 'G'.
MYC-2099 25/27mer DsiRNA, mismatch position=20 of sense strand (from 5'-terminus)

```
5'-CCAUCUUUUUUUUUCUUU^UACAga-3' (SEQ ID NO: 3806)
3'-AUGGUAGAAAAAAAAAAGAAA_UUGUCU-5' (SEQ ID NO: 444)
```

Optionally, the mismatched 'U' residue of position 20 of the sense strand is alternatively 'C' or 'G'.
MYC-2099 25/27mer DsiRNA, mismatch position=21 of sense strand (from 5'-terminus)

```
5'-CCAUCUUUUUUUUUCUUUA^UCAga-3' (SEQ ID NO: 3807)
3'-AUGGUAGAAAAAAAAAAGAAAU_UGUCU-5' (SEQ ID NO: 444)
```

Optionally, the mismatched 'U' residue of position 21 of the sense strand is alternatively 'G' or 'C'.
MYC-2099 25/27mer DsiRNA, mismatch position=22 of sense strand (from 5'-terminus)

```
5'-CCAUCUUUUUUUUUCUUUAA^UAga-3' (SEQ ID NO: 3808)
3'-AUGGUAGAAAAAAAAAAGAAAUU_GUCU-5' (SEQ ID NO: 444)
```

Optionally, the mismatched 'U' residue of position 22 of the sense strand is alternatively 'A' or 'G'.
MYC-2099 25/27mer DsiRNA, mismatch position=23 of sense strand (from 5'-terminus)

```
5'-CCAUCUUUUUUUUUCUUUAAC^Uga-3' (SEQ ID NO: 3809)
3'-AUGGUAGAAAAAAAAAAGAAAUUG_UCU-5' (SEQ ID NO: 444)
```

Optionally, the mismatched 'U' residue of position 23 of the sense strand is alternatively 'C' or 'G'.
MYC-2099 25/27mer DsiRNA, mismatch position=24 of sense strand (from 5'-terminus)

```
5'-CCAUCUUUUUUUUUCUUUAACA^ta-3' (SEQ ID NO: 3810)
3'-AUGGUAGAAAAAAAAAAGAAAUUGU_CU-5' (SEQ ID NO: 444)
```

Optionally, the mismatched 't' residue of position 24 of the sense strand is alternatively 'a' or 'c'.
MYC-2099 25/27mer DsiRNA, mismatch position=25 of sense strand (from 5'-terminus)

```
5'-CCAUCUUUUUUUUUCUUUAACAg^t-3' (SEQ ID NO: 3811)
3'-AUGGUAGAAAAAAAAAAGAAAUUGUC_U-5' (SEQ ID NO: 444)
```

Optionally, the mismatched 't' residue of position 25 of the sense strand is alternatively 'c' or 'g'.

MYC-2099 25/27mer DsiRNA, mismatch position=1 of antisense strand (from 5'-terminus)

5'-CCAUCUUUUUUUUUCUUUAACAg$^a$-3' (SEQ ID NO: 117)
3'-AUGGUAGAAAAAAAAAAGAAAUUGUC$_A$-5' (SEQ ID NO: 3812)

Optionally, the mismatched 'A' residue of position 1 of the antisense strand is alternatively 'G' or 'C'.
MYC-2099 25/27mer DsiRNA, mismatch position=2 of antisense strand (from 5'-terminus)

5'-CCAUCUUUUUUUUUCUUUAACA$^g$a-3' (SEQ ID NO: 117)
3'-AUGGUAGAAAAAAAAAAGAAAUUGU$_A$U-5' (SEQ ID NO: 3813)

Optionally, the mismatched 'A' residue of position 2 of the antisense strand is alternatively 'U' or 'G'.
MYC-2099 25/27mer DsiRNA, mismatch position=3 of antisense strand (from 5'-terminus)

5'-CCAUCUUUUUUUUUCUUUAAC$^A$ga-3' (SEQ ID NO: 117)
3'-AUGGUAGAAAAAAAAAAGAAAUUGU$_A$CU-5' (SEQ ID NO: 3814)

Optionally, the mismatched 'A' residue of position 3 of the antisense strand is alternatively 'C' or 'G'.
MYC-2099 25/27mer DsiRNA, mismatch position=4 of antisense strand (from 5'-terminus)

5'-CCAUCUUUUUUUUUCUUUAA$^C$Aga-3' (SEQ ID NO: 117)
3'-AUGGUAGAAAAAAAAAAGAAAUU$_A$UCU-5' (SEQ ID NO: 3815)

Optionally, the mismatched 'A' residue of position 4 of the antisense strand is alternatively 'U' or 'C'.
MYC-2099 25/27mer DsiRNA, mismatch position=5 of antisense strand (from 5'-terminus)

5'-CCAUCUUUUUUUUUCUUUA$^A$CAga-3' (SEQ ID NO: 117)
3'-AUGGUAGAAAAAAAAAAGAAAU$_A$GUCU-5' (SEQ ID NO: 3816)

Optionally, the mismatched 'A' residue of position 5 of the antisense strand is alternatively 'C' or 'G'.
MYC-2099 25/27mer DsiRNA, mismatch position=6 of antisense strand (from 5'-terminus)

5'-CCAUCUUUUUUUUUCUUU$^A$ACAga-3' (SEQ ID NO: 117)
3'-AUGGUAGAAAAAAAAAAGAAA$_A$UGUCU-5' (SEQ ID NO: 3817)

Optionally, the mismatched 'A' residue of position 6 of the antisense strand is alternatively 'C' or 'G'.
MYC-2099 25/27mer DsiRNA, mismatch position=7 of antisense strand (from 5'-terminus)

5'-CCAUCUUUUUUUUUCUU$^U$AACAga-3' (SEQ ID NO: 117)
3'-AUGGUAGAAAAAAAAAAGAA$_U$UGUCU-5' (SEQ ID NO: 3818)

Optionally, the mismatched 'U' residue of position 7 of the antisense strand is alternatively 'C' or 'G'.

As an additional example, in the below structures, such mismatches are introduced within the asymmetric MYC-2115 DsiRNA (newly-introduced mismatch residues are italicized):

MYC-2115 25/27mer DsiRNA, mismatch position=19 of sense strand (from 5'-terminus)

5'-UUUAACAGAUUUGUAUUU$^U$AGAAtt-3' (SEQ ID NO: 3819)
3'-AGAAAUUGUCUAAACAUAAA$_U$UCUUAA-5' (SEQ ID NO: 619)

Optionally, the mismatched 'U' residue of position 19 of the sense strand is alternatively 'C' or 'G'.
MYC-2115 25/27mer DsiRNA, mismatch position=20 of sense strand (from 5'-terminus)

5'-UUUAACAGAUUUGUAUUUA$^U$GAAtt-3' (SEQ ID NO: 3820)
3'-AGAAAUUGUCUAAACAUAAAU$_U$CUUAA-5' (SEQ ID NO: 619)

Optionally, the mismatched 'U' residue of position 20 of the sense strand is alternatively 'C' or 'G'.
MYC-2115 25/27mer DsiRNA, mismatch position=21 of sense strand (from 5'-terminus)

5'-UUUAACAGAUUUGUAUUUAA$^A$AAtt-3' (SEQ ID NO: 3821)
3'-AGAAAUUGUCUAAACAUAAAUU$_C$UUAA-5' (SEQ ID NO: 619)

Optionally, the mismatched 'A' residue of position 21 of the sense strand is alternatively 'U' or 'C'.
MYC-2115 25/27mer DsiRNA, mismatch position=22 of sense strand (from 5'-terminus)

5'-UUUAACAGAUUUGUAUUUAAG$^G$Att-3' (SEQ ID NO: 3822)
3'-AGAAAUUGUCUAAACAUAAAUUC$_U$UAA-5' (SEQ ID NO: 619)

Optionally, the mismatched 'G' residue of position 22 of the sense strand is alternatively 'U' or 'C'.
MYC-2115 25/27mer DsiRNA, mismatch position=23 of sense strand (from 5'-terminus)

5'-UUUAACAGAUUUGUAUUUAAGA$^U$tt-3' (SEQ ID NO: 3823)
3'-AGAAAUUGUCUAAACAUAAAUUCU$_U$AA-5' (SEQ ID NO: 619)

Optionally, the mismatched 'U' residue of position 23 of the sense strand is alternatively 'C' or 'G'.
MYC-2115 25/27mer DsiRNA, mismatch position=24 of sense strand (from 5'-terminus)

5'-UUUAACAGAUUUGUAUUUAAGAA$^g$t-3' (SEQ ID NO: 3824)
3'-AGAAAUUGUCUAAACAUAAAUUCUU$_A$A-5' (SEQ ID NO: 619)

Optionally, the mismatched 'g' residue of position 24 of the sense strand is alternatively 'a' or 'c'.
MYC-2115 25/27mer DsiRNA, mismatch position=25 of sense strand (from 5'-terminus)

5'-UUUAACAGAUUUGUAUUUAAGAAt$^a$-3' (SEQ ID NO: 3825)
3'-AGAAAUUGUCUAAACAUAAAUUCUUA$_A$-5' (SEQ ID NO: 619)

Optionally, the mismatched 'a' residue of position 25 of the sense strand is alternatively 'c' or 'g'.
MYC-2115 25/27mer DsiRNA, mismatch position=1 of antisense strand (from 5'-terminus)

5'-UUUAACAGAUUUGUAUUUAAGAAt$^t$-3' (SEQ ID NO: 292)
3'-AGAAAUUGUCUAAACAUAAAUUCUUA$_U$-5' (SEQ ID NO: 3826)

Optionally, the mismatched 'U' residue of position 1 of the antisense strand is alternatively 'G' or 'C'.
MYC-2115 25/27mer DsiRNA, mismatch position=2 of antisense strand (from 5'-terminus)

5'-UUUAACAGAUUUGUAUUUAAGAA$^t$t-3' (SEQ ID NO: 292)
3'-AGAAAUUGUCUAAACAUAAAUUCUU$_C$A-5' (SEQ ID NO: 3827)

Optionally, the mismatched 'C' residue of position 2 of the antisense strand is alternatively 'U' or 'G'.
MYC-2115 25/27mer DsiRNA, mismatch position=3 of antisense strand (from 5'-terminus)

5'-UUUAACAGAUUUGUAUUUAAGA$^A$tt-3' (SEQ ID NO: 292)
3'-AGAAAUUGUCUAAACAUAAAUUCU$_A$AA-5' (SEQ ID NO: 3828)

Optionally, the mismatched 'A' residue of position 3 of the antisense strand is alternatively 'C' or 'G'.
MYC-2115 25/27mer DsiRNA, mismatch position=4 of antisense strand (from 5'-terminus)

5'-UUUAACAGAUUUGUAUUUAAG$^A$Att-3' (SEQ ID NO: 292)
3'-AGAAAUUGUCUAAACAUAAAUUC$_C$UAA-5' (SEQ ID NO: 3829)

Optionally, the mismatched 'C' residue of position 4 of the antisense strand is alternatively 'A' or 'G'.
MYC-2115 25/27mer DsiRNA, mismatch position=5 of antisense strand (from 5'-terminus)

5'-UUUAACAGAUUUGUAUUUAA$^G$AAtt-3' (SEQ ID NO: 292)
3'-AGAAAUUGUCUAAACAUAAAUU$_U$UAA-5' (SEQ ID NO: 3830)

Optionally, the mismatched 'U' residue of position 5 of the antisense strand is alternatively 'A' or 'G'.
MYC-2115 25/27mer DsiRNA, mismatch position=6 of antisense strand (from 5'-terminus)

5'-UUUAACAGAUUUGUAUUUA$^A$GAAtt-3' (SEQ ID NO: 292)
3'-AGAAAUUGUCUAAACAUAAAU$_A$CUAA-5' (SEQ ID NO: 3831)

Optionally, the mismatched 'A' residue of position 6 of the antisense strand is alternatively 'C' or 'G'.
MYC-2115 25/27mer DsiRNA, mismatch position=7 of antisense strand (from 5'-terminus)

5'-UUUAACAGAUUUGUAUUU$^A$AGAAtt-3' (SEQ ID NO: 292)
3'-AGAAAUUGUCUAAACAUAAA$_A$UCUAA-5' (SEQ ID NO: 3832)

Optionally, the mismatched 'A' residue of position 7 of the antisense strand is alternatively 'C' or 'G'.

As a further example, in the below structures, such mismatches are introduced within the asymmetric MYC-2120 DsiRNA (newly-introduced mismatch residues are italicized):
MYC-2120 25/27mer DsiRNA, mismatch position=19 of sense strand (from 5'-terminus)

5'-CAGAUUUGUAUUUAAGAA$^A$UGUUtt-3' (SEQ ID NO: 3833)
3'-UUGUCUAAACAUAAAUUCUU$_A$ACAAAA-5' (SEQ ID NO: 447)

Optionally, the mismatched 'A' residue of position 19 of the sense strand is alternatively 'C' or 'G'.
MYC-2120 25/27mer DsiRNA, mismatch position=20 of sense strand (from 5'-terminus)

5'-CAGAUUUGUAUUUAAGAAU$^A$GUUtt-3' (SEQ ID NO: 3834)
3'-UUGUCUAAACAUAAAUUCUUA$_A$CAAAA-5' (SEQ ID NO: 447)

Optionally, the mismatched 'A' residue of position 20 of the sense strand is alternatively 'C' or 'G'.
MYC-2120 25/27mer DsiRNA, mismatch position=21 of sense strand (from 5'-terminus)

5'-CAGAUUUGUAUUUAAGAAUU$^A$UUtt-3' (SEQ ID NO: 3835)
3'-UUGUCUAAACAUAAAUUCUUAA$_C$AAAA-5' (SEQ ID NO: 447)

Optionally, the mismatched 'A' residue of position 21 of the sense strand is alternatively 'U' or 'C'.
MYC-2120 25/27mer DsiRNA, mismatch position=22 of sense strand (from 5'-terminus)

5'-CAGAUUUGUAUUUAAGAAUUG$^G$Utt-3' (SEQ ID NO: 3836)
3'-UUGUCUAAACAUAAAUUCUUAAC$_A$AAA-5' (SEQ ID NO: 447)

Optionally, the mismatched 'G' residue of position 22 of the sense strand is alternatively 'A' or 'C'.
MYC-2120 25/27mer DsiRNA, mismatch position=23 of sense strand (from 5'-terminus)

5'-CAGAUUUGUAUUUAAGAAUUGU$^A$tt-3' (SEQ ID NO: 3837)
3'-UUGUCUAAACAUAAAUUCUUAACA$_A$AA-5' (SEQ ID NO: 447)

Optionally, the mismatched 'A' residue of position 23 of the sense strand is alternatively 'C' or 'G'.
MYC-2120 25/27mer DsiRNA, mismatch position=24 of sense strand (from 5'-terminus)

5'-CAGAUUUGUAUUUAAGAAUUGUU$^g$t-3' (SEQ ID NO: 3838)
3'-UUGUCUAAACAUAAAUUCUUAACAA$_A$A-5' (SEQ ID NO: 447)

Optionally, the mismatched 'g' residue of position 24 of the sense strand is alternatively 'a' or 'c'.

MYC-2120 25/27mer DsiRNA, mismatch position=25 of sense strand (from 5'-terminus)

```
5'-CAGAUUUGUAUUUAAGAAUUGUUtᵃ-3'  (SEQ ID NO: 3839)
3'-UUGUCUAAACAUAAAUUCUUAACAAA_A-5' (SEQ ID NO: 447)
```

Optionally, the mismatched 'a' residue of position 25 of the sense strand is alternatively 'c' or 'g'.

MYC-2120 25/27mer DsiRNA, mismatch position=1 of antisense strand (from 5'-terminus)

```
5'-CAGAUUUGUAUUUAAGAAUUGUUtᵗ-3'  (SEQ ID NO: 120)
3'-UUGUCUAAACAUAAAUUCUUAACAAA_U-5' (SEQ ID NO: 3840)
```

Optionally, the mismatched 'U' residue of position 1 of the antisense strand is alternatively 'G' or 'C'.

MYC-2120 25/27mer DsiRNA, mismatch position=2 of antisense strand (from 5'-terminus)

```
5'-CAGAUUUGUAUUUAAGAAUUGUUᵗt-3'  (SEQ ID NO: 120)
3'-UUGUCUAAACAUAAAUUCUUAACAA_CA-5' (SEQ ID NO: 3841)
```

Optionally, the mismatched 'C' residue of position 2 of the antisense strand is alternatively 'U' or 'G'.

MYC-2120 25/27mer DsiRNA, mismatch position=3 of antisense strand (from 5'-terminus)

```
5'-CAGAUUUGUAUUUAAGAAUUGUᵁtt-3'  (SEQ ID NO: 120)
3'-UUGUCUAAACAUAAAUUCUUAACA_UAA-5' (SEQ ID NO: 3842)
```

Optionally, the mismatched 'U' residue of position 3 of the antisense strand is alternatively 'C' or 'G'.

MYC-2120 25/27mer DsiRNA, mismatch position=4 of antisense strand (from 5'-terminus)

```
5'-CAGAUUUGUAUUUAAGAAUUGᵁUtt-3'  (SEQ ID NO: 120)
3'-UUGUCUAAACAUAAAUUCUUAAC_CAAA-5' (SEQ ID NO: 3843)
```

Optionally, the mismatched 'C' residue of position 4 of the antisense strand is alternatively 'U' or 'G'.

MYC-2120 25/27mer DsiRNA, mismatch position=5 of antisense strand (from 5'-terminus)

```
5'-CAGAUUUGUAUUUAAGAAUUᴳUUtt-3'  (SEQ ID NO: 120)
3'-UUGUCUAAACAUAAAUUCUUAA_UAAAA-5' (SEQ ID NO: 3844)
```

Optionally, the mismatched 'U' residue of position 5 of the antisense strand is alternatively 'A' or 'G'.

MYC-2120 25/27mer DsiRNA, mismatch position=6 of antisense strand (from 5'-terminus)

```
5'-CAGAUUUGUAUUUAAGAAUᵁGUUtt-3'  (SEQ ID NO: 120)
3'-UUGUCUAAACAUAAAUUCUUA_CAAAA-5' (SEQ ID NO: 3845)
```

Optionally, the mismatched 'U' residue of position 6 of the antisense strand is alternatively 'C' or 'G'.

MYC-2120 25/27mer DsiRNA, mismatch position=7 of antisense strand (from 5'-terminus)

```
5'-CAGAUUUGUAUUUAAGAAᵁUGUUtt-3'  (SEQ ID NO: 120)
3'-UUGUCUAAACAUAAAUUCUU_ACAAAA-5' (SEQ ID NO: 3846)
```

Optionally, the mismatched 'U' residue of position 7 of the antisense strand is alternatively 'C' or 'G'.

As another example, in the below structures, such mismatches are introduced within the asymmetric MYC-2196 DsiRNA (newly-introduced mismatch residues are italicized):

MYC-2196 25/27mer DsiRNA, mismatch position=19 of sense strand (from 5'-terminus)

```
5'-UGUAAAUAACUUUAAUAAᵁACGUtt-3'  (SEQ ID NO: 3847)
3'-UUACAUUUAUUGAAAUUAUU_UGCAAA-5' (SEQ ID NO: 624)
```

Optionally, the mismatched 'U' residue of position 19 of the sense strand is alternatively 'C' or 'G'.

MYC-2196 25/27mer DsiRNA, mismatch position=20 of sense strand (from 5'-terminus)

```
5'-UGUAAAUAACUUUAAUAAAᵁCGUtt-3'  (SEQ ID NO: 3848)
3'-UUACAUUUAUUGAAAUUAUUU_GCAAA-5' (SEQ ID NO: 624)
```

Optionally, the mismatched 'U' residue of position 20 of the sense strand is alternatively 'C' or 'G'.

MYC-2196 25/27mer DsiRNA, mismatch position=21 of sense strand (from 5'-terminus)

```
5'-UGUAAAUAACUUUAAUAAAAᴬGUtt-3'  (SEQ ID NO: 3849)
3'-UUACAUUUAUUGAAAUUAUUUU_GCAAA-5' (SEQ ID NO: 624)
```

Optionally, the mismatched 'A' residue of position 21 of the sense strand is alternatively 'U' or 'G'.

MYC-2196 25/27mer DsiRNA, mismatch position=22 of sense strand (from 5'-terminus)

```
5'-UGUAAAUAACUUUAAUAAAACᵁUtt-3'  (SEQ ID NO: 3850)
3'-UUACAUUUAUUGAAAUUAUUUUG_CAAA-5' (SEQ ID NO: 624)
```

Optionally, the mismatched 'U' residue of position 22 of the sense strand is alternatively 'A' or 'C'.

MYC-2196 25/27mer DsiRNA, mismatch position=23 of sense strand (from 5'-terminus)

```
5'-UGUAAAUAACUUUAAUAAAACGᴬtt-3'  (SEQ ID NO: 3851)
3'-UUACAUUUAUUGAAAUUAUUUUGC_AAA-5' (SEQ ID NO: 624)
```

Optionally, the mismatched 'A' residue of position 23 of the sense strand is alternatively 'C' or 'G'.

MYC-2196 25/27mer DsiRNA, mismatch position=24 of sense strand (from 5'-terminus)

```
5'-UGUAAAUAACUUUAAUAAAACGUᵍt-3'  (SEQ ID NO: 3852)
3'-UUACAUUUAUUGAAAUUAUUUUGCA_AA-5' (SEQ ID NO: 642)
```

Optionally, the mismatched 'g' residue of position 24 of the sense strand is alternatively 'a' or 'c'.

MYC-2196 25/27mer DsiRNA, mismatch position=25 of sense strand (from 5'-terminus)

```
5'-UGUAAAUAACUUUAAUAAAACGUtᵃ-3'  (SEQ ID NO: 3853)
3'-UUACAUUUAUUGAAAUUAUUUUGCAA_A-5' (SEQ ID NO: 624)
```

Optionally, the mismatched 'a' residue of position 25 of the sense strand is alternatively 'c' or 'g'.

MYC-2196 25/27mer DsiRNA, mismatch position=1 of antisense strand (from 5'-terminus)

```
5'-UGUAAAUAACUUUAAUAAAACGUtᵗ-3'  (SEQ ID NO: 297)
3'-UUACAUUUAUUGAAAUUAUUUUGCAA_U-5' (SEQ ID NO: 3854)
```

Optionally, the mismatched 'U' residue of position 1 of the antisense strand is alternatively 'G' or 'C'.

MYC-2196 25/27mer DsiRNA, mismatch position=2 of antisense strand (from 5'-terminus)

```
5'-UGUAAAUAACUUUAAUAAAACGUᵗt-3'  (SEQ ID NO: 297)
3'-UUACAUUUAUUGAAAUUAUUUUGCA_CA-5' (SEQ ID NO: 3855)
```

Optionally, the mismatched 'C' residue of position 2 of the antisense strand is alternatively 'U' or 'G'.

MYC-2196 25/27mer DsiRNA, mismatch position=3 of antisense strand (from 5'-terminus)

```
5'-UGUAAAUAACUUUAAUAAAACGᵁtt-3'  (SEQ ID NO: 297)
3'-UUACAUUUAUUGAAAUUAUUUUGC_UAA-5' (SEQ ID NO: 3856)
```

Optionally, the mismatched 'U' residue of position 3 of the antisense strand is alternatively 'C' or 'G'.

MYC-2196 25/27mer DsiRNA, mismatch position=4 of antisense strand (from 5'-terminus)

```
5'-UGUAAAUAACUUUAAUAAAAC_Gutt-3'  (SEQ ID NO: 297)
3'-UUACAUUUAUUGAAAUUAUUUUG_AAAA-5' (SEQ ID NO: 3857)
```

Optionally, the mismatched 'A' residue of position 4 of the antisense strand is alternatively 'U' or 'G'.

MYC-2196 25/27mer DsiRNA, mismatch position=5 of antisense strand (from 5'-terminus)

```
5'-UGUAAAUAACUUUAAUAAAAᶜGUtt-3'  (SEQ ID NO: 297)
3'-UUACAUUUAUUGAAAUUAUUUU_UCAAA-5' (SEQ ID NO: 3858)
```

Optionally, the mismatched 'U' residue of position 5 of the antisense strand is alternatively 'A' or 'C'.

MYC-2196 25/27mer DsiRNA, mismatch position=6 of antisense strand (from 5'-terminus)

```
5'-UGUAAAUAACUUUAAUAAAᴬCGUtt-3'  (SEQ ID NO: 297)
3'-UUACAUUUAUUGAAAUUAUUU_AGCAAA-5' (SEQ ID NO: 3859)
```

Optionally, the mismatched 'A' residue of position 6 of the antisense strand is alternatively 'C' or 'G'.

MYC-2196 25/27mer DsiRNA, mismatch position=7 of antisense strand (from 5'-terminus)

```
5'-UGUAAAUAACUUUAAUAAᴬACGUtt-3'  (SEQ ID NO: 297)
3'-UUACAUUUAUUGAAAUUAUU_AUGCAAA-5' (SEQ ID NO: 3860)
```

Optionally, the mismatched 'A' residue of position 7 of the antisense strand is alternatively 'C' or 'G'.

As an additional example, in the below structures, such mismatches are introduced within the asymmetric MYC-2233 DsiRNA (newly-introduced mismatch residues are italicized):

MYC-2233 25/27mer DsiRNA, mismatch position=19 of sense strand (from 5'-terminus)

```
5'-CAGAAUUUCAAUCCUAGUᵁUAUAgt-3'  (SEQ ID NO: 3861)
3'-GUGUCUUAAAGUUAGGAUCA_UAUAUCA-5' (SEQ ID NO: 455)
```

Optionally, the mismatched 'U' residue of position 19 of the sense strand is alternatively 'C' or 'G'.

MYC-2233 25/27mer DsiRNA, mismatch position=20 of sense strand (from 5'-terminus)

```
5'-CAGAAUUUCAAUCCUAGUAᴬAUAgt-3'  (SEQ ID NO: 3862)
3'-GUGUCUUAAAGUUAGGAUCAU_AUAUCA-5' (SEQ ID NO: 455)
```

Optionally, the mismatched 'A' residue of position 20 of the sense strand is alternatively 'C' or 'G'.

MYC-2233 25/27mer DsiRNA, mismatch position=21 of sense strand (from 5'-terminus)

```
5'-CAGAAUUUCAAUCCUAGUAUᵁUAgt-3'  (SEQ ID NO: 3863)
3'-GUGUCUUAAAGUUAGGAUCAUA_UAUCA-5' (SEQ ID NO: 455)
```

Optionally, the mismatched 'U' residue of position 21 of the sense strand is alternatively 'G' or 'C'.

MYC-2233 25/27mer DsiRNA, mismatch position=22 of sense strand (from 5'-terminus)

```
5'-CAGAAUUUCAAUCCUAGUAUAᴳAgt-3'  (SEQ ID NO: 3864)
3'-GUGUCUUAAAGUUAGGAUCAUAU_AUCA-5' (SEQ ID NO: 455)
```

Optionally, the mismatched 'G' residue of position 22 of the sense strand is alternatively 'A' or 'C'.

MYC-2233 25/27mer DsiRNA, mismatch position=23 of sense strand (from 5'-terminus)

```
5'-CAGAAUUUCAAUCCUAGUAUAUᵁgt-3'  (SEQ ID NO: 3865)
3'-GUGUCUUAAAGUUAGGAUCAUAUAᵤCA-5' (SEQ ID NO: 455)
```

Optionally, the mismatched 'U' residue of position 23 of the sense strand is alternatively 'C' or 'G'.

MYC-2233 25/27mer DsiRNA, mismatch position=24 of sense strand (from 5'-terminus)

```
5'-CAGAAUUUCAAUCCUAGUAUAUAᶜt-3'  (SEQ ID NO: 3866)
3'-GUGUCUUAAAGUUAGGAUCAUAUAUᴄA-5' (SEQ ID NO: 455)
```

Optionally, the mismatched 't' residue of position 24 of the sense strand is alternatively 'a' or 'c'.

MYC-2233 25/27mer DsiRNA, mismatch position=25 of sense strand (from 5'-terminus)

```
5'-CAGAAUUUCAAUCCUAGUAUAUAgᵃ-3'  (SEQ ID NO: 3867)
3'-GUGUCUUAAAGUUAGGAUCAUAUAUCₐ-5' (SEQ ID NO: 455)
```

Optionally, the mismatched 'a' residue of position 25 of the sense strand is alternatively 'c' or 'g'.

MYC-2233 25/27mer DsiRNA, mismatch position=1 of antisense strand (from 5'-terminus)

```
5'-CAGAAUUUCAAUCCUAGUAUAUAgᵗ-3'  (SEQ ID NO: 128)
3'-GUGUCUUAAAGUUAGGAUCAUAUAUCᵤ-5' (SEQ ID NO: 3868)
```

Optionally, the mismatched 'U' residue of position 1 of the antisense strand is alternatively 'G' or 'C'.

MYC-2233 25/27mer DsiRNA, mismatch position=2 of antisense strand (from 5'-terminus)

```
5'-CAGAAUUUCAAUCCUAGUAUAUAᵍt-3'  (SEQ ID NO: 128)
3'-GUGUCUUAAAGUUAGGAUCAUAUAUₐA-5' (SEQ ID NO: 3869)
```

Optionally, the mismatched 'A' residue of position 2 of the antisense strand is alternatively 'U' or 'G'.

MYC-2233 25/27mer DsiRNA, mismatch position=3 of antisense strand (from 5'-terminus)

```
5'-CAGAAUUUCAAUCCUAGUAUAUᴬgt-3'  (SEQ ID NO: 128)
3'-GUGUCUUAAAGUUAGGAUCAUAUAₐCA-5' (SEQ ID NO: 3870)
```

Optionally, the mismatched 'A' residue of position 3 of the antisense strand is alternatively 'C' or 'G'.

MYC-2233 25/27mer DsiRNA, mismatch position=4 of antisense strand (from 5'-terminus)

```
5'-CAGAAUUUCAAUCCUAGUAUAᵁAgt-3'  (SEQ ID NO: 128)
3'-GUGUCUUAAAGUUAGGAUCAUAᴄUCA-5'  (SEQ ID NO: 3871)
```

Optionally, the mismatched 'C' residue of position 4 of the antisense strand is alternatively 'U' or 'G'.

MYC-2233 25/27mer DsiRNA, mismatch position=5 of antisense strand (from 5'-terminus)

```
5'-CAGAAUUUCAAUCCUAGUAUᴬUAgt-3'  (SEQ ID NO: 128)
3'-GUGUCUUAAAGUUAGGAUCAUAₐAUCA-5' (SEQ ID NO: 3872)
```

Optionally, the mismatched 'A' residue of position 5 of the antisense strand is alternatively 'C' or 'G'.

MYC-2233 25/27mer DsiRNA, mismatch position=6 of antisense strand (from 5'-terminus)

```
5'-CAGAAUUUCAAUCCUAGUAᵁAUAgt-3'  (SEQ ID NO: 128)
3'-GUGUCUUAAAGUUAGGAUCAUᵤUAUCA-5' (SEQ ID NO: 3873)
```

Optionally, the mismatched 'U' residue of position 6 of the antisense strand is alternatively 'C' or 'G'.

MYC-2233 25/27mer DsiRNA, mismatch position=7 of antisense strand (from 5'-terminus)

```
5'-CAGAAUUUCAAUCCUAGUᴬUAUAgt-3'  (SEQ ID NO: 128)
3'-GUGUCUUAAAGUUAGGAUCAₐAUAUCA-5' (SEQ ID NO: 3874)
```

Optionally, the mismatched 'A' residue of position 7 of the antisense strand is alternatively 'C' or 'G'.

For the above oligonucleotide strand sequences, it is contemplated that the sense strand sequence of one depicted duplex can be combined with an antisense strand of another depicted duplex, thereby forming a distinct duplex—in certain instances, such duplexes contain a mismatched residue with respect to the MYC target transcript sequence, while such sense and antisense strand sequences do not present a mismatch at this residue with respect to one another (e.g., duplexes comprising SEQ ID NOs: 3707 and 3720; SEQ ID NOs: 3708 and 3719; SEQ ID NOs: 3709 and 3718, etc., are contemplated as exemplary of such duplexes).

As noted above, introduction of mismatches can be performed upon any of the DsiRNAs described herein.

The mismatches of such DsiRNA structures can be combined to produce a DsiRNA possessing, e.g., two, three or even four mismatches within the 3'-terminal four to seven nucleotides of the sense strand/5'-terminal four to seven nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary MYC-953 DsiRNA sequence):

```
                                          (SEQ ID NO: 3875)
         5'-ACGACGAGACCUUCAUCAXXXXXXX[X]ₙ-3'

(SEQ ID NO: 3876)
         3'-CCUGCUGCUCUGGAAGUAGUXXXXXXX[X]ₙ-5'
``` where n=1 to 5, 1 to 10, 1 to 20, 1 to 30, 1 to 50, or 1 to 80 or more.

MYC-953 mRNA Target: 5'-GGACGACGAGACCUU-CAUCAXXXXXXXX-3' (SEQ ID NO: 3877).

The MYC target site may also be a site which is targeted by one or more of several oligonucleotides whose complementary target sites overlap with a stated target site. For example, for an exemplary MYC-953 DsiRNA, it is noted that certain DsiRNAs targeting overlapping and only slightly offset MYC sequences can exhibit activity levels similar to that of MYC-953 (specifically, see MYC-952 of Table 9 below. Thus, in certain embodiments, a designated target sequence region can be effectively targeted by a series of DsiRNAs possessing largely overlapping sequences. (E.g., if considering DsiR-NAs of the MYC-952 and MYC-953 target site(s), a more encompassing MYC transcript target sequence might be recited as, e.g., 5'-CGGACGACGAGACCUUCAU-CAAAAACAU-3' (SEQ ID NO: 3878), wherein any given DsiRNA (e.g., a DsiRNA selected from MYC-952 and MYC-953) only targets a sub-sequence within such a sequence region, yet the entire sequence can be considered a viable target for such a series of DsiRNAs).

Additionally and/or alternatively, mismatches within the 3'-terminal seven nucleotides of the sense strand/5'-terminal seven nucleotides of the antisense strand can be combined with mismatches positioned at other mismatch-tolerant positions, as described above.

In view of the present identification of the above-described Dicer substrate agents (DsiRNAs) as inhibitors of MYC levels via targeting of specific MYC sequences, it is also recognized that dsRNAs having structures similar to those described herein can also be synthesized which target other sequences within the MYC sequence of NM_002467.4 or NM_010849.4, or within variants thereof (e.g., target sequences possessing 80% identity, 90% identity, 95% identity, 96% identity, 97% identity, 98% identity, 99% or more identity to a sequence of NM_002467.4 and/or NM_010849.4).

Anti-MYC DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., MYC RNA) of or derived from the target gene, MYC (or other gene associated with a MYC-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-MYC DsiRNA agents were selected from a pre-screened population. Design of DsiRNAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though a more recent "v3" algorithm represents a theoretically improved algorithm relative to siRNA scoring algorithms previously available in the art. (E.g., the "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-MYC dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev,* 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J,* 390: 675-679). This gene is also known as Thex1 (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem,* 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, *RNA* 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, *Mol Biosyst* 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 *Biochem Pharmacol* 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, *Int J. Cancer* 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, *Nucleic Acids Res* 32: 5991-6000; Hall et al., 2006, *Nucleic Acids Res* 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, *Antisense Nucleic Acid Drug Dev* 13: 83-105; Chiu and Rana, 2003, *Mol Cell* 10: 549-561; Braasch et al., 2003, *Biochemistry* 42: 7967-7975; Amarzguioui et al., 2003, *Nucleic Acids Research* 31: 589-595). More extensive PS modification can be compatible with potent RNAi activity; however, use of sugar modifications (such as 2'-O-methyl RNA) may be superior (Choung et al., 2006, *Biochem Biophys Res Commun* 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, *Biochem Biophys Res Commun* 342: 919-927; Czauderna et al., 2003, *Nucleic Acids Research* 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, *J Med Chem* 48: 901-904; Prakash et al., 2005, *J Med Chem* 48: 4247-4253; Kraynack and Baker, 2006, *RNA* 12: 163-176) and can improve performance and extend duration of action when used in vivo (Morrissey et al., 2005, *Hepatology* 41: 1349-1356; Morrissey et al., 2005, *Nat Biotechnol* 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, *Nature* 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, *Biochemistry* 42: 7967-7975; Grunweller et al., 2003, *Nucleic Acids Res* 31: 3185-3193; Elmen et al., 2005, *Nucleic Acids Res* 33: 439-447). Even with limited incorporation, the use of LNA modifications can improve dsRNA performance in vivo and may also alter or improve off target effect profiles (Mook et al., 2007, *Mol Cancer Ther* 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, *Nat Biotechnol* 23: 1399-1405; Schlee et al., 2006, *Mol Ther* 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, *Nat Biotechnol* 23: 1002-1007; Sioud and Sorensen, 2003, *Biochem Biophys Res Commun* 312: 1220-1225; Sioud, 2005, *J Mol Biol* 348: 1079-1090; Ma et al., 2005, *Biochem Biophys Res Commun* 330: 755-759). RNAs transcribed within the cell are less immunogenic (Robbins et al., 2006, *Nat Biotechnol* 24: 566-571) and synthetic RNAs that are immunogenic when delivered using lipid-based methods can evade immune stimulation when introduced unto cells by mechanical means, even in vivo (Heidel et al., 2004, *Nat Biotechnol* 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-MYC dsRNA agents of the present invention so long as the modification does not prevent the dsRNA agent from possessing MYC inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective MYC inhibition (as described herein, MYC inhibition/MYC inhibitory activity of a dsRNA can be assayed via art-recognized methods for determining RNA levels, or for determining MYC polypeptide levels, should such levels be assessed in lieu of or in addition to assessment of, e.g., MYC mRNA levels). In a third embodiment, one or more modifications are made that support greater MYC inhibitory activity (means of determining MYC inhibitory activity are described supra). In a fourth embodiment, one or more modifications are made that result in greater potency of MYC inhibitory activity per each dsRNA agent molecule to be delivered to the cell (potency of MYC inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858, 988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-MYC DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target MYC RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs showed improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-MYC DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that MYC inhibitory activity of the DsiRNA possessing mismatched base pairs is retained at sufficient levels (e.g., retains at least 50% MYC inhibitory activity or more, at least 60% MYC inhibitory activity or more, at least 70% MYC inhibitory activity or more, at least 80% MYC inhibitory activity or more, at least 90% MYC inhibitory activity or more or at least 95% MYC inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance MYC inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32(Webserver issue):W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002,

*Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Natl Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the MYC RNA.

MYC cDNA and Polypeptide Sequences

Known human and mouse MYC cDNA and polypeptide sequences include the following: human MYC NM_002467.4 and corresponding human MYC polypeptide sequence GenBank Accession No. NP_002458.2; and mouse wild-type MYC sequence GenBank Accession No. NM_010849.4 (*Mus musculus* C57BL/6 MYC transcript, variant 1) and corresponding mouse MYC polypeptide sequence GenBank Accession No. NP_034979.3.

In Vitro Assay to Assess dsRNA MYC Inhibitory Activity

An in vitro assay that recapitulates RNAi in a cell-free system can be used to evaluate dsRNA constructs targeting MYC RNA sequence(s), and thus to assess MYC-specific gene inhibitory activity (also referred to herein as MYC inhibitory activity) of a dsRNA. The assay comprises the system described by Tuschl et al., 1999, Genes and Development, 13, 3191-3197 and Zamore et al., 2000, Cell, 101, 25-33 adapted for use with dsRNA (e.g., DsiRNA) agents directed against MYC RNA. A *Drosophila* extract derived from syncytial blastoderm is used to reconstitute RNAi activity in vitro. Target RNA is generated via in vitro transcription from a selected MYC expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25×Passive Lysis Buffer (Promega). Target RNA cleavage is assayed by RT-PCR analysis or other methods known in the art and are compared to control reactions in which dsRNA is omitted from the reaction.

Alternately, internally-labeled target RNA for the assay is prepared by in vitro transcription in the presence of $[\alpha^{-32}P]$ CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the MYC RNA target for dsRNA mediated RNAi cleavage, wherein a plurality of dsRNA constructs are screened for RNAi mediated cleavage of the MYC RNA target, for example, by analyzing the assay reaction by electrophoresis of labeled target RNA, or by northern blotting, as well as by other methodology well known in the art.

In certain embodiments, a dsRNA of the invention is deemed to possess MYC inhibitory activity if, e.g., a 50% reduction in MYC RNA levels is observed in a system, cell, tissue or organism, relative to a suitable control. Additional metes and bounds for determination of MYC inhibitory activity of a dsRNA of the invention are described supra.

Conjugation and Delivery of Anti-MYC dsRNA Agents

In certain embodiments the present invention relates to a method for treating a subject having a MYC-associated disease or disorder, or at risk of developing a MYC-associated disease or disorder. In such embodiments, the dsRNA can act as novel therapeutic agents for controlling the MYC-associated disease or disorder. The method comprises administering a pharmaceutical composition of the invention to the patient (e.g., human), such that the expression, level and/or activity of a MYC RNA is reduced. The expression, level and/or activity of a polypeptide encoded by a MYC RNA might also be reduced by a dsRNA of the instant invention, even where said dsRNA is directed against a non-coding region of the MYC transcript (e.g., a targeted 5' UTR or 3' UTR sequence). Because of their high specificity, the dsRNAs of the present invention can specifically target MYC sequences of cells and tissues, optionally in an allele-specific manner where polymorphic alleles exist within an individual and/or population.

In the treatment of a MYC-associated disease or disorder, the dsRNA can be brought into contact with the cells or tissue of a subject, e.g., the cells or tissue of a subject exhibiting disregulation of MYC and/or otherwise targeted for reduction of MYC levels. For example, dsRNA substantially identical to all or part of a MYC RNA sequence, may be brought into contact with or introduced into such a cell, either in vivo or in vitro. Similarly, dsRNA substantially identical to all or part of a MYC RNA sequence may administered directly to a subject having or at risk of developing a MYC-associated disease or disorder.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the MYC RNA, or that not only target MYC RNA but also target, e.g., cellular target genes associated with a MYC-associated disease or disorder. A dsRNA agent of the instant invention may also be constructed such that either strand of the dsRNA agent independently targets two or more regions of MYC RNA, or such that one of the strands of the dsRNA agent targets a cellular target gene of MYC known in the art.

Use of multifunctional dsRNA molecules that target more then one region of a target nucleic acid molecule can also provide potent inhibition of MYC RNA levels and expression. For example, a single multifunctional dsRNA construct of the invention can target both the MYC-1916 and MYC-1572 sites simultaneously; additionally and/or alternatively, single or multifunctional agents of the invention can be designed to selectively target one splice variant of MYC over another.

Thus, the dsRNA agents of the instant invention, individually, or in combination or in conjunction with other drugs, can be used to treat, inhibit, reduce, or prevent a MYC-associated disease or disorder. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent a MYC-associated disease or disorder in a subject or organism. For example, the described molecules could be used in combination with one or more known compounds, treatments, or procedures to treat, inhibit, reduce, or prevent a MYC-associated disease or disorder in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or other-wise increase inhibition of the target MYC RNA.

A cell having a target MYC RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target MYC RNA sequence and the dose of dsRNA agent material delivered, this process may provide partial or complete loss of function for the MYC RNA. A reduction or loss of RNA levels or expression (either MYC RNA expression or encoded polypeptide expression) in at least 50%, 60%, 70%, 80%, 90%, 95% or 99% or more of targeted cells is exemplary. Inhibition of MYC RNA levels or expression refers to the absence (or observable decrease) in the level of MYC RNA or MYC RNA-encoded protein. Specificity refers to the ability to inhibit the MYC RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target MYC RNA sequence(s) by the dsRNA agents of the invention also can be measured based upon the effect of administration of such dsRNA agents upon development/progression of a MYC-associated disease or disorder, e.g., tumor formation, growth, metastasis, etc., either in vivo or in vitro. Treatment and/or reductions in tumor or cancer cell levels can include halting or reduction of growth of tumor or cancer cell levels or reductions of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in cancer cell levels could be achieved via administration of the dsRNA agents of the invention to cells, a tissue, or a subject.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyltransferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target MYC RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

MYC Biology and MYC-Targeting Therapeutics

MYC (c-MYC) is a proto-oncogene, which is overexpressed in a wide range of human cancers. When it is specifically mutated, or overexpressed, it increases cell proliferation and functions as an oncogene. The MYC gene encodes for a transcription factor that regulates expression of 15% of all genes through binding on Enhancer Box sequences (E-boxes) and recruiting histone acetyltransferases (HATs). MYC belongs to the MYC family of transcription factors, which also includes N-MYC and L-MYC genes. MYC-family transcription factors contain a bHLH/LZ (basic Helix-Loop-Helix Leucine Zipper) domain. Myc protein, through its bHLH domain, can bind to DNA, while the leucine zipper domain of Myc allows for dimerization with a partner protein, Max, another bHLH transcription factor.

The MYC gene was initially identified and characterized in Burkitt's lymphoma patients. In Burkitt's lymphoma, cancer cells show chromosomal translocations, frequently involving Chromosome 8. Cloning of the fusion chromosome break point revealed a gene that was similar to myelocytomatosis viral oncogene (v-MYC). Thus, the newfound cellular gene was named c-MYC.

Myc protein is a transcription factor that activates expression of a great number of genes through binding on consensus sequences (Enhancer Box sequences (E-boxes)) and recruiting histone acetyltransferases (HATs). It can also act as a transcriptional repressor. By binding Miz-1 transcription factor and displacing the p300 co-activator, it inhibits expression of Miz-1 target genes.

Myc is activated through various mitogenic signaling pathways, such as Wnt, Shh and EGF (via the MAPK/ERK pathway). By modifying the expression of its target genes, Myc activation results in numerous biological effects, including enhancement of cell proliferation (upregulates cyclins, downregulates p21), regulation of cell growth (upregulates ribosomal RNA and proteins), apoptosis (upregulates Bcl-2), differentiation and stem cell self-renewal. MYC is a strong proto-oncogene and it has been found to be upregulated in many types of cancers.

During discovery of MYC, chromosomes that translocated to Chromosome 8 were identified to contain immunoglobulin (Ig) genes at the break point. Post-translocation, enhancers of immunoglobin genes were instead causing overexpression of MYC in lymphoma cells. Transgenic mouse models that overexpress MYC were then developed to study the mechanism of tumorigenesis in Burkitt's lymphoma—e.g., transgenic mice overexpressing MYC (MYC under control of the IgM heavy chain enhancer) developed lymphomas when MYC was placed under control of the IgM heavy chain enhancer, or various other types of tumor when MYC overexpression occurred in other tissues (e.g., liver, breast), illustrating the potency of MYC as an oncogene.

References useful for understanding c-MYC biology include: Gearhart J, Pashos E E, Prasad M K, Pluripotency Redeux—advances in stem-cell researcg, N Engl J Med 357 (15):1469. Ruf I K, Rhyne P W, Yang H, et al. (2002). "EBV regulates c-MYC, apoptosis, and tumorigenicity in Burkitt's lymphoma," Curr. Top. Microbiol. Immunol. 258: 153-60. PMID 11443860. Lüscher B (2001). "Function and regulation of the transcription factors of the Myc/Max/Mad network,". Gene 277 (1-2): 1-14. PMID 11602341. Hoffman B, Amanullah A, Shafarenko M, Liebermann D A (2002), "The proto-oncogene c-myc in hematopoietic development and leukemogenesis," Oncogene 21 (21): 3414-21, doi:10.1038/sj.one.1205400. PMID 12032779. Pelengaris S, Khan M, Evan G (2002), "c-MYC: more than just a matter of life and death," Nat. Rev. Cancer 2 (10): 764-76, doi:10.1038/nrc904. PMID 12360279. Nilsson J A, Cleveland J L (2004), "Myc pathways provoking cell suicide and cancer," Oncogene 22 (56): 9007-21. doi:10.1038/sj.one.1207261. PMID 14663479. Dang C V, O'donnell K A, Juopperi T (2005), "The great MYC escape in tumorigenesis," Cancer Cell 8 (3): 177-8, doi:10.1016/j.ccr.2005.08.005. PMID 16169462. Dang C V, Li F, Lee L A (2007), "Could MYC induction of mitochondrial biogenesis be linked to ROS production and genomic instability?" Cell Cycle 4 (11): 1465-6, PMID 16205115. Coller H A, Forman J J, Legesse-Miller A (2007), "'Myc'ed messages': myc induces transcription of E2F1 while inhibiting its translation via a microRNA polycistron," PLoS Genet. 3(8): e146, doi:10.1371/journal.pgen.0030146. PMID 17784791. Astrin S M, Laurence J (1992), "Human immunodeficiency virus activates c-myc and Epstein-Ban virus in human B lymphocytes," Ann. N.Y. Acad. Sci. 651: 422-32, PMID 1318011. Bernstein P L, Herrick D J, Prokipcak R D, Ross J (1992), "Control of c-myc mRNA half-life in vitro by a protein capable of binding to a coding region stability determinant," Genes Dev. 6 (4): 642-54, PMID 1559612. Iijima S, Teraoka H, Date T, Tsukada K (1992), "DNA-activated protein kinase in Raji Burkitt's lymphoma cells. Phosphorylation of c-Myc oncoprotein," Eur. J. Biochem. 206 (2): 595-603, PMID 1597196. Seth A, Alvarez E, Gupta S, Davis R J (1992), "A phosphorylation site located in the NH2-terminal domain of c-Myc increases transactivation of gene expression," J. Biol. Chem. 266 (35): 23521-4, PMID 1748630. Takahashi E, Hori T, O'Connell P, et al. (1991), "Mapping of the MYC gene to band 8q24.12-q24.13 by R-banding and distal to fra(8)(q24.11), FRA8E, by fluorescence in situ hybridization," Cytogenet. Cell Genet. 57 (2-3): 109-11, PMID 1914517. Blackwood E M, Eisenman R N (1991), "Max: a helix-loop-helix zipper protein that forms a sequence-specific DNA-binding complex with Myc," Science 251 (4998): 1211-7, PMID 2006410. Gazin C, Rigolet M, Briand J P, et al. (1986), "Immunochemical detection of proteins related to the human c-myc exon 1," EMBO J. 5 (9): 2241-50, PMID 2430795. Lüscher B, Kuenzel E A, Krebs E G, Eisenman R N (1989), "Myc oncoproteins are phosphorylated by casein kinase II," EMBO J. 8 (4): 1111-9, PMID 2663470. Finver S N, Nishikura K, Finger L R, et al. (1988), "Sequence analysis of the MYC oncogene involved in the t(8; 14)(q24;q11) chromosome translocation in a human leukemia T-cell line indicates that putative regulatory regions are not altered," Proc. Natl. Acad. Sci. U.S.A. 85 (9): 3052-6, PMID 2834731. Showe L C, Moore R C, Erikson J, Croce C M (1987), "MYC oncogene involved in a t(8; 22) chromosome translocation is not altered in its putative regulatory regions," Proc. Natl. Acad. Sci. U.S.A. 84 (9): 2824-8, PMID 3033665. Guilhot S, Petridou B, Syed-Hussain S, Galibert F (1989), "Nucleotide sequence 3' to the human c-myc oncogene; presence of a long inverted repeat," Gene 72 (1-2): 105-8, PMID 3243428. Hann S R, King M W, Bentley D L, et al. (1988), "A non-AUG translational initiation in c-myc exon 1 generates an N-terminally distinct protein whose synthesis is disrupted in Burkitt's lymphomas," Cell 52 (2): 185-95; PMID 3277717.

MYC-inhibiting small molecules have recently been identified (Moyer. *Nature Medicine* 17: 1325). The MYC-inhibiting double stranded nucleic acids of the instant invention can be used alone, or in combination with any art-recognized MYC-targeting therapeutic, such as those recited therein.

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a MYC RNA can be determined by a suitable method now known in the art or that is later developed. It can be appreciated that the method used to measure a target RNA and/or the expression of a target RNA can depend upon the nature of the target RNA. For example, where the target MYC RNA sequence encodes a protein, the term "expression" can refer to a protein or the MYC RNA/transcript derived from the MYC gene (either genomic or of exogenous origin). In such instances the expression of the target MYC RNA can be determined by measuring the amount of MYC RNA/transcript directly or by measuring the amount of Myc protein. Protein can be measured in protein assays such as by staining or immunoblotting or, if the protein catalyzes a reaction that can be measured, by measuring reaction rates. All such methods are known in the art and can be used. Where target MYC RNA levels are to be measured, art-recognized methods for detecting RNA levels can be used (e.g., RT-PCR, Northern Blotting, etc.). In targeting MYC RNAs with the dsRNA agents of the instant invention, it is also anticipated that measurement of the efficacy of a dsRNA agent in reducing levels of MYC RNA or protein in a subject, tissue, in cells, either in vitro or in vivo, or in cell extracts can also be used to determine the extent of reduction of MYC-associated phenotypes (e.g., disease or disorders, e.g., cancer or tumor formation, growth, metastasis, spread, etc.). The above measurements can be made on cells, cell extracts, tissues, tissue extracts or other suitable source material.

The determination of whether the expression of a MYC RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by MYC (e.g., misregulation and/or elevation of MYC transcript and/or Myc protein levels), or treatable via selective targeting of MYC.

"Treatment", or "treating" as used herein, is defined as the application or administration of a therapeutic agent (e.g., a dsRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of transforming events within a subject via inhibition of MYC expression), by administering to the subject a therapeutic agent (e.g., a dsRNA agent or vector or transgene encoding same). Subjects at risk for the disease can be identified by, for example, one or a combination of diagnostic or prognostic assays as described herein. Administration of a prophylactic agent can occur prior to the detection of, e.g., cancer in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target MYC RNA molecules of the present invention or target MYC RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of MYC mRNA Levels and Expression

Cell Culture

The dsRNA agents of the invention can be tested for cleavage activity in vivo, for example, using the following procedure. The nucleotide sequences within the MYC cDNA targeted by the dsRNA agents of the invention are shown in the above MYC sequences.

The dsRNA reagents of the invention can be tested in cell culture using A549 or other mammalian cells to determine the extent of MYC RNA and Myc protein inhibition. In certain embodiments, DsiRNA reagents (e.g., see FIG. 1, and above-recited structures) are selected against the MYC target as described herein. MYC RNA inhibition is measured after delivery of these reagents by a suitable transfection agent to, for example, cultured A549 cells or other transformed or non-transformed mammalian cells in culture. Relative amounts of target MYC RNA are measured versus actin or other appropriate control using real-time PCR monitoring of amplification (e.g., ABI 7700 TAQMAN®). A comparison is made to the activity of oligonucleotide sequences made to unrelated targets or to a randomized DsiRNA control with the same overall length and chemistry, or simply to appropriate vehicle-treated or untreated controls. Primary and secondary lead reagents are chosen for the target and optimization performed.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAM-MYCA conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1×TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target MYC mRNA level is determined relative to standards generated from serially diluted total cellular RNA (300, 100, 30, 10 ng/rxn) and normalizing to, for example, HPRT1 mRNA in either parallel or same tube TaqMan reactions.

Western Blotting

Cellular protein extracts can be prepared using a standard micro preparation technique (for example using RIPA buffer), or preferably, by extracting nuclear proteins by a method such as the NE-PER Nuclear and Cytoplasmic Extraction kit (Thermo-Fisher Scientific). Cellular protein extracts are run on Tris-Glycine polyacrylamide gel and transferred onto membranes. Non-specific binding can be blocked by incubation, for example, with 5% non-fat milk for 1 hour followed by primary antibody for 16 hours at 4° C.

Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to Opti-MEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-MYC dsRNA agents may be evaluated in an animal model. Animal models of cancer and/or proliferative diseases, conditions, or disorders as are known in the art can be used for evaluation of the efficacy, potency, toxicity, etc. of anti-MYC dsRNAs. Suitable animal models of proliferative disease include, e.g., transgenic rodents (e.g., mice, rats) bearing gain of function proto-oncogenes (e.g., Myc, Src) and/or loss of function of tumour suppressor proteins (e.g., p53, Rb) or rodents that have been exposed to radiation or chemical mutagens that induce DNA changes that facilitate neoplastic transformation. Many such animal models are commercially available, for example, from The Jackson Laboratory, Bar Harbor, Me., USA. These animal models may be used as a source cells or tissue for assays of the compositions of the invention. Such models can also be used or adapted for use for pre-clinical evaluation of the efficacy of dsRNA compositions of the invention in modulating MYC gene expression toward therapeutic use.

As in cell culture models, the most MYC relevant mouse tumor xenografts are those derived from cancer cells that express Myc proteins. Xenograft mouse models of cancer relevant to study of the anti-tumor effect of modulating MYC have been described by various groups (e.g., Leonetti et al., J. NCI-1996 April; 88: 419; Iversen et al., Clin Cancer Res 2003 July; 9: 2510; Devi et al., Clin Cancer Res 2005 May; 11: 3930; Chen et al., Mol Ther 2010 April; 18:828; Kessler et al., Science 2012 January; 335: 348). Use of these models has demonstrated that inhibition of MYC expression by anti-MYC agents causes inhibition of tumor growth in animals.

Such models can be used in evaluating the efficacy of dsRNA molecules of the invention to inhibit MYC levels, expression, tumor/cancer formation, growth, spread, development of other MYC-associated phenotypes, diseases or disorders, etc. These models and others can similarly be used to evaluate the safety/toxicity and efficacy of dsRNA molecules of the invention in a pre-clinical setting.

Specific examples of animal model systems useful for evaluation of the MYC-targeting dsRNAs of the invention include wild-type mice, and orthotopic or subcutaneous HT1080, HCT116, SW480, SW620, Hep3B, M14, JR8, PLF2, LLC1, LNCaP, PC3, SUM159, MDAMB-231, 22Rv1, 518A2, MHCC97, A549, H1299, HepG2, SNU398, HuH7, NCI-H196, NCI-H1975, HT29, MKN-45, MDA-MB-231, NCI-H441, Panc-1, MiaPaCa2, BxPC3, DU-145, M2182, VCaP, OvCar-3, MCF-7, U937, K562, HeLa, T98G, or SHP-77 tumor model mice. In an exemplary in vivo experiment, dsRNAs of the invention are tail vein injected into such mouse models at doses ranging from 1 to 10 mg/kg or, alternatively, repeated doses are administered at single-dose $IC_{50}$ levels, and organs (e.g., prostate, liver, kidney, lung, pancreas, colon, skin, spleen, bone marrow, lymph nodes, mammary fat pad, etc.) are harvested 24 hours after administration of the final dose. Such organs are then evaluated for mouse and/or human MYC levels, depending upon the model used. Duration of action can also be examined at, e.g., 1, 4, 7, 14, 21 or more days after final dsRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (Danio rerio), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1

Preparation of Double-Stranded RNA Oligonucleotides

Oligonucleotide Synthesis and Purification

DsiRNA molecules can be designed to interact with various sites in the RNA message, for example, target sequences within the RNA sequences described herein. In presently exemplified agents, 327 human target MYC sequences and 144 mouse target MYC sequences were selected for evaluation (183 of the 327 human target MYC sites were predicted to be conserved with corresponding sites in the mouse MYC transcript sequence). The sequences of one strand of the DsiRNA molecules were complementary to the target MYC site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varies from 90:10 Buffers A:B to 52:48 Buffers A:B, where Buffer A is 100 mM Tris pH 8.5 and Buffer B is 100 mM Tris pH 8.5, 1 M NaCl. Samples were monitored at 260 nm and peaks corresponding to the full-length oligonucleotide species are collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 µm inner diameter and contains ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that are at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 µM concentration in duplex buffer consisting of 100 mM potassium acetate, 30 mM HEPES, pH 7.5. Complementary sense and antisense strands were mixed in equal molar amounts to yield a final solution of, e.g., 50 µM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

A549 cells were obtained from ATCC and maintained in DMEM (HyClone) supplemented with 10% fetal bovine serum (HyClone) at 37° C. under 5% $CO_2$. Hepa 1-6 cells were obtained from ATCC and maintained in DMEM (HyClone) supplemented with 10% fetal bovine serum (HyClone) at 37° C. under 5% $CO_2$. For RNA transfections, cells were transfected with DsiRNAs as indicated at a final concentration of 1 nM, 0.3 nM or 0.1 nM using Lipofectamine™ RNAiMAX (Invitrogen) and following manufacturer's instructions. Briefly, for 0.1 nM transfections, e.g., of Example 3 below, an aliquot of stock solution of each DsiRNA was mixed with Opti-MEM I (Invitrogen) and Lipofectamine™ RNAiMAX to reach a volume of 150 µL (with 0.3 nM DsiRNA). The resulting 150 µL mix was incubated for 20 min at RT to allow DsiRNA:Lipofectamine™ RNAiMAX complexes to form. Meanwhile, target cells were trypsinized and resuspended in medium. At the end of the 20 min of complexation, 50 uL of the DsiRNA:RNAiMAX mixture was added per well into triplicate wells of 96 well plates. Finally, 100 µL of the cell suspension were added to each well (final volume 150 µL) and plates were placed into the incubator for 24 hours.

Assessment of MYC Inhibition

MYC target gene knockdown was determined by qRT-PCR, with values normalized to HPRT and SFRS9 housekeeping genes, and to transfections with control DsiRNAs and/or mock transfection controls.

RNA Isolation and Analysis

Media was aspirated, and total RNA was extracted using the SV96 kit (Promega). Total RNA was reverse-transcribed using SuperscriptII, Oligo dT, and random hexamers following manufacturer's instructions. Typically, the resulting cDNA was analyzed by qPCR using primers and probes specific for both the MYC gene and for the human genes HPRT-1 and SFRS9. An ABI 7700 was used for the amplification reactions. Each sample was tested in triplicate. Relative MYC RNA levels were normalized to HPRT1 and SFRS9 RNA levels and compared with RNA levels obtained in transfection control samples.

Example 2

DsiRNA Inhibition of MYC

DsiRNA molecules targeting MYC were designed and synthesized as described above and tested in human A549 cells or mouse Hepa 1-6 cells for inhibitory efficacy. For transfection, annealed DsiRNAs were mixed with the transfection reagent (Lipofectamine™ RNAiMAX, Invitrogen) and incubated for 20 minutes at room temperature. The A549 (human) or Hepa 1-6 (mouse) cells were trypsinized, resuspended in media, and added to wells (100 uL per well) to give a final DsiRNA concentration of 1 nM in a volume of 150 µl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA prepared from each well. Target MYC RNA levels following treatment were evaluated by qRT-PCR for the MYC target gene, with values normalized to those obtained for controls. Triplicate data was averaged and the % error determined for each treatment. Normalized data were graphed and the reduction of target mRNA by active DsiR-NAs in comparison to controls was determined.

MYC targeting DsiRNAs examined for MYC inhibitory efficacy in an initial phase of testing are indicated in Table 8 below. In this example, 471 asymmetric DsiRNAs (tested DsiRNAs possessed a 25/27mer structure) were constructed and tested for MYC inhibitory efficacy in human A549 and mouse Hepa 1-6 cells incubated in the presence of such DsiR-NAs at a concentration of 1 nM. The 471 asymmetric DsiR-NAs tested in the initial screen included DsiRNAs possessing 2'-O-methyl modified residues as shown in Tables 2 and 4 above, where underlined nucleotide residues indicate 2'-O-methyl modified residues, ribonucleotide residues are shown as UPPER CASE, and deoxyribonucleotide residues are shown as lower case.

Assay of the 471 MYC targeting DsiRNAs in human A549 and mouse Hepa 1-6 cells at 1 nM revealed the following MYC inhibitory efficacies, presented in Tables 9 and 10. MYC levels were determined using qPCR assays positioned at indicated locations within the MYC transcript (for human A549 cell experiments, three distinct qPCR assays were performed and are indicated as "Hs MYC 514-620" (FAM), "Hs MYC 1227-1347" (MAX) and "Hs MYC 1771-1882" (MAX); for mouse Hepa 1-6 cell experiments, three distinct qPCR assays were performed and are indicated as "Mm MYC 539-663" (FAM), "Mm MYC 1339-1428" (MAX) and "Mm MYC 1971-2062" (MAX).

TABLE 9

MYC Inhibitory Efficacy of DsiRNAs Assayed at 1 nM in Human A549 Cells and Mouse Hepa 1-6 Cells

| DsiRNA Name (Human MYC Target Location, NM_002467.4) | Mouse MYC Target Location (NM_010849.4) | Human A549 Cells % Remaining MYC mRNA ± % Error (Assay: Hs MYC 514-620 (FAM)) | Human A549 Cells % Remaining MYC mRNA ± % Error (Assay: Hs MYC 1227-1347 (MAX)) | Human A549 Cells % Remaining MYC mRNA ± % Error (Assay: Hs MYC 1771-1882 (MAX)) |
|---|---|---|---|---|
| MYC-94 | | 141.4 ± 4.5 | 155.9 ± 3 | 97.8 ± 2.6 |
| MYC-178 | | 78.9 ± 3.6 | 72 ± 5.2 | 72.3 ± 2.2 |
| MYC-365 | | 135.3 ± 8.1 | 81.2 ± 11.6 | 86.4 ± 6.3 |
| MYC-370 | | 64.5 ± 4.7 | 62.2 ± 12 | 74.4 ± 1.5 |
| MYC-376 | | 125.7 ± 6.7 | 86.6 ± 6 | 94.1 ± 5.3 |
| MYC-403 | | 98.2 ± 1.1 | 65.4 ± 6.5 | 76.2 ± 2.9 |
| MYC-409 | | 74.8 ± 5.3 | 71.1 ± 9.6 | 67.8 ± 4.2 |
| MYC-417 | | 120.2 ± 3.3 | 130.8 ± 2.2 | 97.2 ± 1.4 |
| MYC-535 | | 82 ± 7.1 | 102.9 ± 7.6 | 92.9 ± 6.1 |
| MYC-541 | | 55.4 ± 3.2 | 66 ± 7.5 | 77.6 ± 4.3 |
| MYC-548 | | 41.7 ± 5.5 | 70 ± 2.2 | 71.9 ± 1.2 |
| MYC-553 | | 58.1 ± 8.5 | 114.8 ± 11 | 84.8 ± 9.4 |
| MYC-562 | | 55.3 ± 6.5 | 83.6 ± 6.9 | 83.8 ± 0.9 |
| MYC-601 | | 33.3 ± 11.6 | 87.5 ± 12.1 | 81.6 ± 2.2 |
| MYC-607 | | 30 ± 6.2 | 55 ± 8.8 | 55.5 ± 1.4 |
| MYC-643 | | 69.1 ± 12.7 | 87.9 ± 17 | 79.4 ± 13.1 |
| MYC-651 | | 59.5 ± 8.9 | 71.4 ± 10 | 61.8 ± 4.6 |
| MYC-676 | | 57.2 ± 5.7 | 79.3 ± 6.4 | 89.3 ± 4.9 |
| MYC-731 | | 74.3 ± 10.9 | 101.4 ± 12.3 | 109.5 ± 5.7 |
| MYC-816 | | 85.9 ± 9.8 | 87.8 ± 19.8 | 83.6 ± 2.5 |
| MYC-920 | | 41.2 ± 4.1 | 61.7 ± 1.8 | 60.5 ± 2.3 |
| MYC-949 | | 39.2 ± 7.8 | 56.5 ± 10.1 | 70.7 ± 6.2 |
| MYC-958 | | 63.3 ± 11.8 | 93.9 ± 16.6 | 82.5 ± 6.5 |
| MYC-970 | | 44.8 ± 2.4 | 52.4 ± 4.6 | 55.8 ± 5.1 |
| MYC-987 | | 81.7 ± 7.5 | 85.4 ± 10.2 | 79.8 ± 3.1 |
| MYC-1104 | | 87.3 ± 4.3 | 119.9 ± 4.1 | 75.4 ± 11.9 |
| MYC-1111 | | 49.6 ± 7.5 | 95.9 ± 6.9 | 65.3 ± 4.8 |
| MYC-1116 | | 49.3 ± 0.8 | 65.6 ± 1.9 | 49.4 ± 4.9 |
| MYC-1210 | | 73.6 ± 3.5 | 138.6 ± 4.4 | 87.1 ± 2.6 |
| MYC-1340 | | 46.5 ± 5.2 | 52.6 ± 4.2 | 67 ± 14.7 |
| MYC-1346 | | 41.2 ± 4 | 38.1 ± 5.2 | 73 ± 14.9 |
| MYC-1351 | | 45.8 ± 10.5 | 42.9 ± 9.2 | 63.1 ± 3.2 |
| MYC-1358 | | 54.2 ± 6.1 | 61.9 ± 10.6 | 88.7 ± 2.1 |
| MYC-1364 | | 42.3 ± 4.8 | 39.1 ± 2.5 | 48.6 ± 5.4 |
| MYC-1370 | | 40.6 ± 1.7 | 31.3 ± 5.4 | 41.4 ± 5.4 |
| MYC-1376 | | 68.5 ± 4.3 | 57.8 ± 5.2 | 68.1 ± 0.8 |
| MYC-1382 | | 41.7 ± 1.5 | 33.2 ± 4.3 | 38.1 ± 1.2 |
| MYC-1401 | | 72 ± 5.8 | 71.2 ± 8.7 | 63.3 ± 5.6 |
| MYC-1406 | | 118.6 ± 5 | 138.1 ± 9.3 | 96.3 ± 5.8 |
| MYC-1411 | | 92.7 ± 5.5 | 78.5 ± 6.8 | 85.8 ± 2.8 |
| MYC-1416 | | 86.7 ± 5.7 | 77.4 ± 9.6 | 85.3 ± 7.5 |
| MYC-1421 | | 72.3 ± 4.2 | 74.4 ± 3.9 | 74 ± 4.7 |
| MYC-1457 | | 47.3 ± 8.7 | 38.1 ± 14.1 | 52.3 ± 4.6 |
| MYC-1465 | | 42.6 ± 8.3 | 28.7 ± 7.8 | 54.4 ± 4.1 |
| MYC-1531 | | 85.6 ± 1.7 | 71.2 ± 1 | 83.2 ± 5.8 |

TABLE 9-continued

MYC Inhibitory Efficacy of DsiRNAs Assayed at 1 nM in Human A549 Cells and Mouse Hepa 1-6 Cells

| DsiRNA Name (Human MYC Target Location, NM_002467.4) | Mouse MYC Target Location (NM_010849.4) | Human A549 Cells % Remaining MYC mRNA ± % Error (Assay: Hs MYC 514-620 (FAM)) | Human A549 Cells % Remaining MYC mRNA ± % Error (Assay: Hs MYC 1227-1347 (MAX)) | Human A549 Cells % Remaining MYC mRNA ± % Error (Assay: Hs MYC 1771-1882 (MAX)) |
|---|---|---|---|---|
| MYC-1538 | | 110.8 ± 6.4 | 104 ± 6.8 | 92.3 ± 7 |
| MYC-1550 | | 100.7 ± 4 | 91 ± 5.5 | 91 ± 3.5 |
| MYC-1555 | | 56.2 ± 1.5 | 43.9 ± 4.3 | 91.5 ± 5.1 |
| MYC-1560 | | 106.7 ± 7.6 | 99.2 ± 9.7 | 92.9 ± 9 |
| MYC-1565 | | 76.2 ± 6.3 | 87.2 ± 7.3 | 87.6 ± 2.3 |
| MYC-1570 | | 70.3 ± 2.7 | 58.8 ± 1.2 | 64.2 ± 2 |
| MYC-1575 | | 60.4 ± 5.7 | 52.4 ± 6.3 | 71.1 ± 4.4 |
| MYC-1584 | | 46.7 ± 3.1 | 32.5 ± 3 | 91.9 ± 4.9 |
| MYC-1593 | | 78.8 ± 3.2 | 59.6 ± 4.2 | 104.3 ± 1.6 |
| MYC-1599 | | 53.6 ± 5.9 | 47.8 ± 7 | 67 ± 6.3 |
| MYC-1634 | | 101.8 ± 9.5 | 126.4 ± 12.1 | 95.4 ± 1.9 |
| MYC-1639 | | 52.5 ± 1.9 | 47.8 ± 1.9 | 95.7 ± 3.1 |
| MYC-1687 | | 55.3 ± 5.3 | 47.1 ± 7.9 | 106.1 ± 2.7 |
| MYC-1693 | | 66.1 ± 2.4 | 67.5 ± 1.6 | 82.9 ± 7.5 |
| MYC-1698 | | 36.3 ± 4.7 | 26.8 ± 5.5 | 34.9 ± 4 |
| MYC-1704 | | 83.7 ± 3.5 | 69.8 ± 18 | 77.1 ± 6.4 |
| MYC-1709 | | 55.5 ± 7.7 | 62.5 ± 12 | 102.8 ± 5.5 |
| MYC-1729 | | 65.9 ± 2.8 | 57.2 ± 3.3 | 65.9 ± 4.5 |
| MYC-1734 | | 37.5 ± 1.4 | 32.6 ± 3.5 | 51.6 ± 2.4 |
| MYC-1739 | | 58.5 ± 3.4 | 50.3 ± 5.9 | 66.2 ± 4.3 |
| MYC-1769 | | 38.6 ± 3.1 | 32.5 ± 2.5 | 38.8 ± 3.4 |
| MYC-1774 | | 74.5 ± 3.4 | 76.4 ± 1 | 74.8 ± 0.7 |
| MYC-1779 | | 29.3 ± 2.7 | 32.6 ± 3.9 | 63.9 ± 4.6 |
| MYC-1784 | | 90.8 ± 2.7 | 98.5 ± 4.8 | 71.5 ± 5.6 |
| MYC-1789 | | 64 ± 7.4 | 59.1 ± 8.6 | 67.4 ± 3.2 |
| MYC-1795 | | 44.3 ± 2.9 | 38.4 ± 5.3 | 48.9 ± 2.3 |
| MYC-1803 | | 71.2 ± 3 | 60.1 ± 5.6 | 62.1 ± 3.6 |
| MYC-1808 | | 50.8 ± 3.4 | 41.1 ± 5 | 41.3 ± 5.8 |
| MYC-1816 | | 61 ± 2.4 | 57.1 ± 4.5 | 65.2 ± 3.5 |
| MYC-1823 | | 40.9 ± 4.7 | 43.6 ± 7.6 | 38 ± 4.8 |
| MYC-1828 | | 37.2 ± 2.9 | 31.7 ± 3.1 | 32.4 ± 2.7 |
| MYC-1834 | | 66.4 ± 1.8 | 68.4 ± 4.5 | 63.6 ± 7 |
| MYC-1840 | | 68.8 ± 3.9 | 67.9 ± 6.1 | 51.5 ± 3.1 |
| MYC-1845 | | 46.7 ± 5 | 38.7 ± 6.7 | 39.3 ± 2.5 |
| MYC-1850 | | 60.2 ± 8.9 | 52.7 ± 6.8 | 41 ± 5.6 |
| MYC-1855 | | 42.2 ± 2.6 | 34.2 ± 1.9 | 31.8 ± 2.8 |
| MYC-1882 | | 51.1 ± 7.1 | 46 ± 9.3 | 35.9 ± 6 |
| MYC-1888 | | 100.1 ± 4.2 | 128.5 ± 3 | 86.6 ± 9.2 |
| MYC-1893 | | 68.8 ± 4.1 | 69 ± 1.9 | 47.6 ± 6.7 |
| MYC-1900 | | 60.7 ± 1.2 | 67.5 ± 3.7 | 53.3 ± 2 |
| MYC-1906 | | 63.8 ± 2.1 | 52 ± 7 | 61.5 ± 8.2 |
| MYC-1911 | | 41.7 ± 1.6 | 40.9 ± 1.4 | 35.5 ± 2.2 |
| MYC-1921 | | 55.7 ± 3.2 | 44.3 ± 5.2 | 56.6 ± 4.7 |
| MYC-1926 | | 53.8 ± 4.7 | 59.6 ± 4.6 | 41.9 ± 6 |
| MYC-1931 | | 45.3 ± 3.7 | 38.9 ± 7.3 | 36.6 ± 2.6 |
| MYC-1937 | | 77.7 ± 5.5 | 75.3 ± 6.6 | 51.8 ± 5.3 |
| MYC-1944 | | 69.1 ± 5.9 | 66.7 ± 7.1 | 38.1 ± 7.6 |
| MYC-1953 | | 104.8 ± 2.8 | 134.3 ± 2.7 | 57.7 ± 2.3 |
| MYC-1959 | | 109.7 ± 4.7 | 119.6 ± 4.1 | 62.2 ± 8.6 |
| MYC-1965 | | 59.4 ± 3.5 | 56.4 ± 7.3 | 35.9 ± 7.1 |
| MYC-1970 | | 67.6 ± 2.8 | 61.8 ± 3.1 | 47 ± 7.2 |
| MYC-1976 | | 77.8 ± 0.3 | 91.4 ± 0.8 | 47.1 ± 4.5 |
| MYC-1981 | | 92.2 ± 5.9 | 94.1 ± 7.7 | 47 ± 5.9 |
| MYC-1989 | | 60.2 ± 2.5 | 52.4 ± 3.3 | 38 ± 2.8 |
| MYC-1994 | | 111.3 ± 2.7 | 149.4 ± 6.3 | 46.8 ± 3 |
| MYC-2001 | | 86.3 ± 10.7 | 92.5 ± 15.3 | 31.9 ± 2 |
| MYC-2006 | | 84.3 ± 5.1 | 82.6 ± 6 | 38.5 ± 2.4 |
| MYC-2013 | | 90.2 ± 2 | 66.8 ± 4.6 | 32.7 ± 1.5 |
| MYC-2019 | | 73.4 ± 4.2 | 60.3 ± 6.9 | 52.5 ± 2.8 |
| MYC-2026 | | 75 ± 2.9 | 83.8 ± 4.4 | 48.2 ± 9.2 |
| MYC-2031 | | 76.1 ± 4.1 | 60.1 ± 5.2 | 49.7 ± 5.3 |
| MYC-2040 | | 73.3 ± 7.4 | 71.9 ± 12 | 33.4 ± 5.7 |
| MYC-2048 | | 88 ± 3.1 | 75.4 ± 4 | 45.9 ± 3.9 |
| MYC-2054 | | 118.4 ± 9.2 | 109.4 ± 9.1 | 77.4 ± 5.5 |
| MYC-2059 | | 80.8 ± 4.8 | 84.1 ± 3.8 | 57.9 ± 2.9 |
| MYC-2066 | | 62.7 ± 6 | 52.9 ± 5 | 38.9 ± 9.7 |
| MYC-2073 | | 76 ± 0.6 | 76.3 ± 0.3 | 43.2 ± 8.2 |
| MYC-2078 | | 94.8 ± 2.4 | 88.2 ± 3.6 | 66.6 ± 3.8 |

TABLE 9-continued

MYC Inhibitory Efficacy of DsiRNAs Assayed at 1 nM in Human A549 Cells and Mouse Hepa 1-6 Cells

| DsiRNA Name (Human MYC Target Location, NM_002467.4) | Mouse MYC Target Location (NM_010849.4) | Human A549 Cells % Remaining MYC mRNA ± % Error (Assay: Hs MYC 514-620 (FAM)) | Human A549 Cells % Remaining MYC mRNA ± % Error (Assay: Hs MYC 1227-1347 (MAX)) | Human A549 Cells % Remaining MYC mRNA ± % Error (Assay: Hs MYC 1771-1882 (MAX)) |
|---|---|---|---|---|
| MYC-2083 | | 76.5 ± 2.1 | 64.3 ± 3.4 | 32.3 ± 4 |
| MYC-2089 | | 85.8 ± 3.5 | 68.4 ± 5.4 | 54 ± 2.8 |
| MYC-2094 | | 69.7 ± 1.1 | 52.7 ± 4.9 | 33 ± 2.1 |
| MYC-2099 | | 60.1 ± 5.5 | 56.5 ± 6.5 | 30.4 ± 11.4 |
| MYC-2105 | | 81.6 ± 5.5 | 87.8 ± 5 | 84.6 ± 7.5 |
| MYC-2114 | | 73.6 ± 7.7 | 57.9 ± 8.9 | 30.8 ± 3.1 |
| MYC-2120 | | 60.1 ± 3.1 | 50.2 ± 9.1 | 27.3 ± 5.9 |
| MYC-2128 | | 72.8 ± 3 | 70.5 ± 2 | 52 ± 1.9 |
| MYC-2135 | | 81.1 ± 4 | 74.1 ± 7.6 | 65.6 ± 5.5 |
| MYC-2167 | | 100.1 ± 6.3 | 100.6 ± 10.5 | 62.5 ± 1.6 |
| MYC-2176 | | 85.8 ± 6.2 | 73.5 ± 8.9 | 43.9 ± 6.2 |
| MYC-2181 | | 76.1 ± 1.2 | 74.2 ± 3.3 | 59.7 ± 1.3 |
| MYC-2188 | | 80.2 ± 3 | 71.2 ± 3.9 | 34.4 ± 1 |
| MYC-2207 | | 80.3 ± 5.8 | 71.2 ± 9.3 | 58 ± 6.7 |
| MYC-2233 | | 72 ± 2.1 | 70.6 ± 1.9 | 39.1 ± 5.9 |
| MYC-2260 | | 86.9 ± 6.3 | 94.8 ± 9.6 | 50.7 ± 7.4 |
| MYC-2267 | | 99.8 ± 3.9 | 115.7 ± 3.1 | 83.6 ± 4.6 |
| MYC-2274 | | 92.3 ± 2.7 | 79.5 ± 5.8 | 81.8 ± 3.6 |
| MYC-2282 | | 100 ± 5.5 | 121.4 ± 5.1 | 64 ± 15.8 |
| MYC-2287 | | 102.5 ± 5.3 | 91.1 ± 7 | 84.2 ± 3 |
| MYC-2295 | | 100.1 ± 4.2 | 109.6 ± 4.1 | 91.7 ± 5.2 |
| MYC-2300 | | 73.2 ± 5.2 | 83.4 ± 3.4 | 43.5 ± 5.8 |
| MYC-2306 | | 57.6 ± 7.8 | 47.6 ± 9 | 40.1 ± 3.4 |
| MYC-2312 | | 100.1 ± 13.1 | 109.8 ± 15.4 | 70.7 ± 6.8 |
| MYC-2334 | | 94 ± 5.8 | 86.2 ± 5.7 | 80.9 ± 5.3 |
| MYC-2339 | | 101.8 ± 1.5 | 100.4 ± 11.1 | 78.3 ± 0.6 |
| MYC-2347 | | 71.9 ± 8.3 | 70.9 ± 11.7 | 60.7 ± 9.7 |
| MYC-2355 | | 72 ± 3.2 | 64.8 ± 4.7 | 53.8 ± 3.3 |
| MYC-2364 | | 90.6 ± 5.8 | 84.1 ± 5.6 | 71.5 ± 5.4 |
| MYC-2371 | | 103.8 ± 5.9 | 100.6 ± 5.8 | 79.1 ± 2.9 |
| MYC-2377 | | 92.7 ± 1.9 | 116 ± 2.7 | 93.8 ± 2.5 |
| MYC-188 | 235 | 140.6 ± 7.7 | 197.8 ± 8.6 | 113.6 ± 3.9 |
| MYC-189 | 236 | 110.6 ± 2.5 | 137.3 ± 2 | 94.1 ± 4.1 |
| MYC-190 | 237 | 129.5 ± 9.7 | 135.6 ± 11.3 | 90.3 ± 3.8 |
| MYC-191 | 238 | 119.5 ± 3 | 122.3 ± 2.9 | 83 ± 2.9 |
| MYC-192 | 239 | 129.7 ± 7.4 | 131.9 ± 10.1 | 93.9 ± 3.7 |
| MYC-193 | 240 | 110.7 ± 2.5 | 120.4 ± 1.5 | 96 ± 2.2 |
| MYC-194 | 241 | 131.7 ± 3.2 | 151.6 ± 3.7 | 103.1 ± 1.5 |
| MYC-195 | 242 | 95.5 ± 5 | 124.1 ± 5.3 | 86.2 ± 3.6 |
| MYC-612 | 668 | 73.3 ± 4.1 | 123.5 ± 6.7 | 89.3 ± 1.8 |
| MYC-613 | 669 | 72.3 ± 4.8 | 107.2 ± 6.2 | 79.9 ± 2 |
| MYC-614 | 670 | 98.9 ± 1.3 | 104.5 ± 5 | 73.2 ± 12 |
| MYC-615 | 671 | 82.5 ± 5.1 | 83 ± 5.2 | 71.5 ± 2.7 |
| MYC-616 | 672 | 68.4 ± 8.4 | 74.9 ± 8.7 | 69.2 ± 5.6 |
| MYC-617 | 673 | 99.1 ± 7.9 | 102.9 ± 8.1 | 89.6 ± 2.7 |
| MYC-618 | 674 | 69.4 ± 3.5 | 96.7 ± 5.9 | 81.2 ± 3.1 |
| MYC-619 | 675 | 57.7 ± 3.8 | 103 ± 6.1 | 87.3 ± 5.2 |
| MYC-620 | 676 | 80.1 ± 2.9 | 120 ± 4.2 | 102.6 ± 5 |
| MYC-621 | 677 | 61.3 ± 5.2 | 126.8 ± 8.6 | 113.6 ± 3.1 |
| MYC-622 | 678 | 36 ± 3.1 | 138.3 ± 4.8 | 124.4 ± 8.4 |
| MYC-623 | 679 | 51.7 ± 2.4 | 81.2 ± 5.1 | 84.5 ± 4.1 |
| MYC-624 | 680 | 67.1 ± 5.8 | 84.2 ± 7.7 | 80.5 ± 7.8 |
| MYC-625 | 681 | 69.4 ± 4.5 | 78.1 ± 5.4 | 75.7 ± 2.8 |
| MYC-626 | 682 | 59.4 ± 3.2 | 65.9 ± 3.1 | 72.9 ± 5.6 |
| MYC-627 | 683 | 66 ± 6.9 | 75.4 ± 13.4 | 80.8 ± 0.6 |
| MYC-628 | 684 | 128.9 ± 7.6 | 190.5 ± 9 | 112.7 ± 5.7 |
| MYC-629 | 685 | 120.9 ± 3.9 | 157.4 ± 5.8 | 105.4 ± 1.6 |
| MYC-733 | 789 | 95.9 ± 3.3 | 114.9 ± 6.3 | 99.9 ± 5.9 |
| MYC-734 | 790 | 86.3 ± 6.4 | 91.6 ± 7.4 | 84 ± 6 |
| MYC-735 | 791 | 105.2 ± 4.3 | 105 ± 2.7 | 90.3 ± 3.5 |
| MYC-736 | 792 | 70.3 ± 7.5 | 79.8 ± 8.8 | 77.4 ± 8.2 |
| MYC-737 | 793 | 108.6 ± 3.7 | 124.3 ± 5.7 | 93.1 ± 3.1 |
| MYC-738 | 794 | 116.3 ± 29.5 | 168.2 ± 11.3 | 146.5 ± 2.6 |
| MYC-739 | 795 | 97.2 ± 17 | 125.6 ± 11.7 | 111.3 ± 2 |
| MYC-740 | 796 | 123.3 ± 7.5 | 138.2 ± 8.5 | 113 ± 3 |
| MYC-741 | 797 | 88.2 ± 6.3 | 98.9 ± 7.6 | 90 ± 3.9 |
| MYC-742 | 798 | 73.9 ± 7 | 84.7 ± 7.2 | 84.9 ± 3 |
| MYC-743 | 799 | 97.6 ± 3.4 | 90.7 ± 5.6 | 106.3 ± 6.4 |

TABLE 9-continued

MYC Inhibitory Efficacy of DsiRNAs Assayed at 1 nM in Human A549 Cells and Mouse Hepa 1-6 Cells

| DsiRNA Name (Human MYC Target Location, NM_002467.4) | Mouse MYC Target Location (NM_010849.4) | Human A549 Cells % Remaining MYC mRNA ± % Error (Assay: Hs MYC 514-620 (FAM)) | Human A549 Cells % Remaining MYC mRNA ± % Error (Assay: Hs MYC 1227-1347 (MAX)) | Human A549 Cells % Remaining MYC mRNA ± % Error (Assay: Hs MYC 1771-1882 (MAX)) |
|---|---|---|---|---|
| MYC-784 | 840 | 89.4 ± 6.9 | 81.6 ± 13 | 91.9 ± 3.3 |
| MYC-785 | 841 | 89.5 ± 4.2 | 92.6 ± 4.1 | 96.9 ± 3.9 |
| MYC-786 | 842 | 93.1 ± 3.1 | 99.7 ± 5.7 | 97.5 ± 3.3 |
| MYC-787 | 843 | 104.1 ± 11.3 | 128.9 ± 12.7 | 107.7 ± 4.4 |
| MYC-788 | 844 | 115 ± 1.1 | 126.7 ± 1 | 100.2 ± 3 |
| MYC-913 | 972 | 55.8 ± 3.6 | 66.8 ± 7.2 | 80.1 ± 1.4 |
| MYC-914 | 973 | 61.9 ± 3.9 | 63.2 ± 4.5 | 68.7 ± 5.6 |
| MYC-915 | 974 | 64.1 ± 4 | 61.3 ± 6.1 | 82.5 ± 4.6 |
| MYC-916 | 975 | 69.5 ± 3.4 | 65.6 ± 2.7 | 81.1 ± 2.2 |
| MYC-917 | 976 | 66.2 ± 8.4 | 68.1 ± 9 | 76.3 ± 3.2 |
| MYC-952 | 1011 | 46.4 ± 4 | 70.6 ± 5.5 | 93.9 ± 1.9 |
| MYC-953 | 1012 | 36.8 ± 4.2 | 67 ± 2.7 | 59.9 ± 9.1 |
| MYC-973 | 1032 | 107 ± 8.2 | 122.6 ± 12 | 98.9 ± 2.6 |
| MYC-974 | 1033 | 115.8 ± 4.3 | 126.4 ± 2.7 | 96.3 ± 2.4 |
| MYC-975 | 1034 | 103.1 ± 6.1 | 104.4 ± 13.2 | 94.3 ± 5.1 |
| MYC-976 | 1035 | 86 ± 4.8 | 86.9 ± 6.2 | 76.3 ± 4.4 |
| MYC-977 | 1036 | 105.1 ± 2.9 | 104.8 ± 5.2 | 91.6 ± 2.6 |
| MYC-978 | 1037 | 104.5 ± 2 | 108.8 ± 4.6 | 91.5 ± 3.3 |
| MYC-979 | 1038 | 113.8 ± 6.7 | 141.7 ± 3.1 | 104.7 ± 1 |
| MYC-980 | 1039 | 122.8 ± 7.7 | 162.3 ± 9 | 105.9 ± 3.9 |
| MYC-981 | 1040 | 85.5 ± 5.9 | 97 ± 7.5 | 81.1 ± 3.8 |
| MYC-982 | 1041 | 123.1 ± 2.6 | 114.8 ± 9.7 | 102.3 ± 16.1 |
| MYC-983 | 1042 | 105.6 ± 2.7 | 96.2 ± 2.8 | 89.4 ± 4.6 |
| MYC-984 | 1043 | 99.3 ± 5.2 | 90.1 ± 10.2 | 82.9 ± 4.6 |
| MYC-985 | 1044 | 96.3 ± 6.3 | 80.3 ± 4.8 | 90.8 ± 0.9 |
| MYC-986 | 1045 | 86.6 ± 1.7 | 85 ± 7.1 | 86.2 ± 5.5 |
| MYC-1033 | 1092 | 100.3 ± 1.1 | 124.6 ± 3.2 | 100.7 ± 2.6 |
| MYC-1034 | 1093 | 91.8 ± 4.9 | 118.3 ± 5.1 | 99.9 ± 4.8 |
| MYC-1035 | 1094 | 110.9 ± 8.6 | 118.9 ± 11.4 | 100.3 ± 4.2 |
| MYC-1036 | 1095 | 109.1 ± 4.3 | 108.3 ± 5.6 | 90.4 ± 5.9 |
| MYC-1037 | 1096 | 100.7 ± 5.6 | 90.1 ± 8.8 | 85.6 ± 3.1 |
| MYC-1038 | 1097 | 110.6 ± 4 | 98.2 ± 7.4 | 90.8 ± 3.2 |
| MYC-1039 | 1098 | 98.1 ± 2.3 | 79 ± 2.6 | 93.9 ± 4.6 |
| MYC-1040 | 1099 | 99.3 ± 5.9 | 90.3 ± 7.3 | 93.5 ± 4.9 |
| MYC-1041 | 1100 | 89.3 ± 2.9 | 88.2 ± 4.5 | 91.6 ± 3.7 |
| MYC-1042 | 1101 | 104.2 ± 6.5 | 159.6 ± 8.5 | 104.7 ± 6.4 |
| MYC-1043 | 1102 | 125.6 ± 4.8 | 150.1 ± 0.9 | 102.6 ± 3.9 |
| MYC-1044 | 1103 | 95.7 ± 3 | 117 ± 6.3 | 83.9 ± 3.4 |
| MYC-1045 | 1104 | 81 ± 4 | 106.8 ± 2.2 | 81.6 ± 3.8 |
| MYC-1046 | 1105 | 60.5 ± 4.4 | 101.5 ± 11.1 | 96.9 ± 5.8 |
| MYC-1047 | 1106 | 86.3 ± 5 | 102 ± 5.5 | 83.3 ± 5.6 |
| MYC-1048 | 1107 | 98.9 ± 3.2 | 114.1 ± 7 | 86.7 ± 7.7 |
| MYC-1049 | 1108 | 85.6 ± 14.5 | 89.4 ± 10.4 | 80.4 ± 23.7 |
| MYC-1050 | 1109 | 79.7 ± 1 | 102.3 ± 1.6 | 81 ± 1.5 |
| MYC-1051 | 1110 | 106.2 ± 12.2 | 119.9 ± 13.5 | 89.9 ± 7.5 |
| MYC-1052 | 1111 | 98.6 ± 1.2 | 94.1 ± 2.4 | 78.1 ± 3 |
| MYC-1053 | 1112 | 111.3 ± 5.2 | 103.5 ± 5.3 | 85.2 ± 4.3 |
| MYC-1096 | 1155 | 98.3 ± 4.2 | 93.1 ± 5.9 | 87.8 ± 1.4 |
| MYC-1097 | 1156 | 72.2 ± 5.1 | 101.5 ± 7.3 | 85.9 ± 5.2 |
| MYC-1098 | 1157 | 51.9 ± 3.7 | 103.4 ± 11.4 | 66.3 ± 2.5 |
| MYC-1099 | 1158 | 73.9 ± 9.5 | 92.5 ± 13.7 | 84.6 ± 3.1 |
| MYC-1100 | 1159 | 64 ± 2.9 | 92.8 ± 4.7 | 83.5 ± 6.7 |
| MYC-1101 | 1160 | 104.2 ± 4.7 | 117.6 ± 6.3 | 100.8 ± 5.1 |
| MYC-1189 | 1248 | 95 ± 4.4 | 110 ± 4.4 | 84.3 ± 4 |
| MYC-1190 | 1249 | 95.1 ± 4.1 | 127.8 ± 7.2 | 84.5 ± 3.9 |
| MYC-1191 | 1250 | 66.6 ± 1.5 | 212.4 ± 4.1 | 93.2 ± 2 |
| MYC-1192 | 1251 | 62.3 ± 3.7 | 228.9 ± 4.2 | 92.6 ± 2.3 |
| MYC-1193 | 1252 | 75.3 ± 2.7 | 118.2 ± 2.7 | 74.7 ± 2.7 |
| MYC-1315 | 1371 | 81.7 ± 2.3 | 50.3 ± 3.3 | 98.7 ± 5.1 |
| MYC-1316 | 1372 | 127.1 ± 7.8 | 162.8 ± 7.6 | 106.3 ± 8.5 |
| MYC-1317 | 1373 | 139.5 ± 5 | 154.7 ± 7.3 | 122.7 ± 4.3 |
| MYC-1318 | 1374 | 123.7 ± 8.4 | 131.5 ± 12.8 | 97 ± 3.5 |
| MYC-1319 | 1375 | 121.9 ± 4.1 | 111.2 ± 4.7 | 93.1 ± 1.8 |
| MYC-1320 | 1376 | 126.1 ± 6.8 | 100.4 ± 6.1 | 111.9 ± 6.1 |
| MYC-1321 | 1377 | 115.6 ± 4.2 | 108.8 ± 5.1 | 100.8 ± 5.7 |
| MYC-1322 | 1378 | 106.2 ± 6.3 | 108.1 ± 6.2 | 93.1 ± 7 |
| MYC-1323 | 1379 | 99.5 ± 5.9 | 113.5 ± 7.8 | 102.4 ± 3.8 |
| MYC-1324 | 1380 | 118.1 ± 3.8 | 144.1 ± 5.5 | 101.9 ± 3.9 |

TABLE 9-continued

MYC Inhibitory Efficacy of DsiRNAs Assayed at 1 nM in Human A549 Cells and Mouse Hepa 1-6 Cells

| DsiRNA Name (Human MYC Target Location, NM_002467.4) | Mouse MYC Target Location (NM_010849.4) | Human A549 Cells % Remaining MYC mRNA ± % Error (Assay: Hs MYC 514-620 (FAM)) | Human A549 Cells % Remaining MYC mRNA ± % Error (Assay: Hs MYC 1227-1347 (MAX)) | Human A549 Cells % Remaining MYC mRNA ± % Error (Assay: Hs MYC 1771-1882 (MAX)) |
|---|---|---|---|---|
| MYC-1325 | 1381 | 139.3 ± 5 | 155.5 ± 5.5 | 119.6 ± 5.5 |
| MYC-1326 | 1382 | 152.2 ± 3.9 | 100.2 ± 16.7 | 138.1 ± 5.1 |
| MYC-1327 | 1383 | 91.8 ± 2.4 | 60.8 ± 3.6 | 79.2 ± 3.6 |
| MYC-1328 | 1384 | 91.2 ± 2.4 | 74.6 ± 2.7 | 82 ± 2.1 |
| MYC-1329 | 1385 | 79.9 ± 6.9 | 64.1 ± 8.6 | 76.9 ± 1.8 |
| MYC-1330 | 1386 | 78 ± 2.8 | 67.3 ± 3.8 | 73.6 ± 7 |
| MYC-1331 | 1387 | 95.2 ± 2 | 100.4 ± 1.7 | 97.3 ± 2.9 |
| MYC-1332 | 1388 | 75.4 ± 4.7 | 78.9 ± 6.4 | 79.9 ± 3.6 |
| MYC-1333 | 1389 | 59.2 ± 1.5 | 50.1 ± 1.9 | 67.8 ± 2.3 |
| MYC-1334 | 1390 | 76.2 ± 1.1 | 64.9 ± 3.7 | 75 ± 5.2 |
| MYC-1360 | 1416 | 37.5 ± 6.2 | 25.7 ± 6.8 | 47.5 ± 3.8 |
| MYC-1361 | 1417 | 79.4 ± 3.3 | 64.6 ± 1.7 | 81.8 ± 2 |
| MYC-1448 | 1504 | 81.4 ± 6.4 | 68.9 ± 5.9 | 83.4 ± 2.4 |
| MYC-1468 | 1524 | 37.4 ± 2.5 | 25.6 ± 3.9 | 50.4 ± 4.9 |
| MYC-1469 | 1525 | 74.7 ± 4.9 | 63.6 ± 9.8 | 81.4 ± 5.3 |
| MYC-1470 | 1526 | 93.3 ± 5.3 | 114.6 ± 9.6 | 94 ± 5.4 |
| MYC-1471 | 1527 | 127.8 ± 6.8 | 144.6 ± 12.4 | 115.4 ± 5.9 |
| MYC-1472 | 1528 | 102.1 ± 2.1 | 110.3 ± 9.2 | 91.4 ± 2.7 |
| MYC-1473 | 1529 | 84.8 ± 7.1 | 73.3 ± 9.2 | 86.2 ± 3.9 |
| MYC-1474 | 1530 | 111.4 ± 3.2 | 113 ± 6.2 | 106.6 ± 9.3 |
| MYC-1475 | 1531 | 86.9 ± 6.5 | 92.1 ± 11.9 | 88.1 ± 4.2 |
| MYC-1476 | 1532 | 80.7 ± 7.1 | 89.1 ± 10.3 | 85.7 ± 6.5 |
| MYC-1477 | 1533 | 68.9 ± 7.4 | 89.1 ± 18.1 | 99.3 ± 5.9 |
| MYC-1478 | 1534 | 109.1 ± 2 | 144 ± 15 | 113.5 ± 1.8 |
| MYC-1479 | 1535 | 105.1 ± 8.8 | 118.7 ± 8.6 | 106.9 ± 4.6 |
| MYC-1480 | 1536 | 96.1 ± 2.6 | 98.5 ± 6.6 | 102.1 ± 2.5 |
| MYC-1481 | 1537 | 102.7 ± 1.7 | 91 ± 6.9 | 96.5 ± 6.2 |
| MYC-1482 | 1538 | 55.2 ± 2.1 | 40.2 ± 10.1 | 99.4 ± 2.8 |
| MYC-1483 | 1539 | 33.7 ± 1.6 | 22.7 ± 12 | 108.6 ± 1.8 |
| MYC-1711 | 1767 | 31.1 ± 4.8 | 25 ± 11.4 | 113.8 ± 2.5 |
| MYC-1712 | 1768 | 36.1 ± 6.7 | 32.8 ± 8.7 | 144.5 ± 4.5 |
| MYC-1713 | 1769 | 75.1 ± 3.5 | 88.7 ± 4.1 | 83.7 ± 4.5 |
| MYC-1714 | 1770 | 70.5 ± 6.6 | 78.1 ± 14.9 | 72 ± 3 |
| MYC-1715 | 1771 | 72 ± 1.7 | 73.2 ± 5.1 | 63 ± 4.8 |
| MYC-1716 | 1772 | 72.2 ± 2.3 | 65.9 ± 8.2 | 68.5 ± 2.8 |
| MYC-1717 | 1773 | 94.8 ± 5.5 | 78.8 ± 6.2 | 84.2 ± 3.7 |
| MYC-1718 | 1774 | 91.2 ± 3.3 | 76.4 ± 16.5 | 79.8 ± 2.1 |
| MYC-1719 | 1775 | 96.5 ± 6.8 | 89.8 ± 16.2 | 95.1 ± 4.6 |
| MYC-1720 | 1776 | 80.8 ± 7 | 84.3 ± 14.3 | 89.3 ± 10.8 |
| MYC-1721 | 1777 | 120.7 ± 12.9 | 155.7 ± 21.3 | 108.4 ± 5.7 |
| MYC-1856 | 1912 | 97 ± 5 | 116.8 ± 6.4 | 68.4 ± 3.3 |
| MYC-1857 | 1913 | 79.9 ± 3.5 | 77 ± 7.5 | 64.4 ± 1.2 |
| MYC-2115 | 2195 | 86.8 ± 6.8 | 79.7 ± 12.5 | 41.3 ± 2.3 |
| MYC-2116 | 2196 | 106.4 ± 4.1 | 107.8 ± 6.8 | 77.7 ± 17.1 |
| MYC-2193 | 2273 | 119.9 ± 3.3 | 125.2 ± 8.9 | 91.5 ± 2.9 |
| MYC-2194 | 2274 | 125.6 ± 2.7 | 141.2 ± 2.8 | 85.4 ± 5.4 |
| MYC-2195 | 2275 | 106.4 ± 8.4 | 136.6 ± 13.7 | 74.4 ± 2.8 |
| MYC-2196 | 2276 | 101 ± 5.5 | 117.2 ± 4.9 | 46.3 ± 3.5 |
| MYC-2197 | 2277 | 114.6 ± 3.9 | 131.3 ± 3.4 | 59.1 ± 1.1 |
| MYC-2198 | 2278 | 109.5 ± 7.9 | 122.6 ± 17.2 | 95.1 ± 4.1 |
| MYC-2199 | 2279 | 89 ± 6 | 73.8 ± 6.5 | 74.7 ± 4.7 |
| MYC-2200 | 2280 | 110.2 ± 2.1 | 104.6 ± 2 | 79.7 ± 2 |
| MYC-2201 | 2281 | 98.5 ± 5.9 | 89.2 ± 6 | 71 ± 3.8 |
| MYC-2202 | 2282 | 108.7 ± 5.4 | 103.2 ± 5.8 | 81.3 ± 2.8 |
| MYC-2203 | 2283 | 107.3 ± 3.9 | 118.3 ± 6.7 | 94.8 ± 3.8 |
| MYC-2204 | 2284 | 117.1 ± 4 | 144.2 ± 4 | 96.4 ± 2.7 |
| MYC-2205 | 2285 | 92.7 ± 5.1 | 97 ± 5.6 | 81 ± 9.6 |
| MYC-2313 | 2363 | 88.9 ± 3 | 79.1 ± 2.8 | 88.5 ± 3.6 |
| MYC-2314 | 2364 | 99.5 ± 2.9 | 89.1 ± 4.9 | 95.1 ± 4.9 |
| MYC-2315 | 2365 | 108.9 ± 5.8 | 96.1 ± 8.7 | 92.5 ± 5.4 |
| MYC-2316 | 2366 | 78.8 ± 3 | 67 ± 3.5 | 80.8 ± 1.3 |
| MYC-2317 | 2367 | 90.3 ± 2.9 | 81.6 ± 2.7 | 86.7 ± 1.7 |
| MYC-2318 | 2368 | 93.8 ± 11.4 | 85.2 ± 11.5 | 87.9 ± 6.2 |
| MYC-2319 | 2369 | 125.9 ± 4.7 | 160.6 ± 6.7 | 104.6 ± 4 |
| MYC-2320 | 2370 | 139.2 ± 5.4 | 159 ± 4.2 | 102.1 ± 4.8 |
| MYC-2321 | 2371 | 108 ± 3.5 | 104.5 ± 3.9 | 69.4 ± 4.4 |
| MYC-2322 | 2372 | 143.6 ± 2 | 136.9 ± 5.4 | 102.3 ± 2.1 |
| MYC-2323 | 2373 | 173.9 ± 4.7 | 160.6 ± 4.8 | 122 ± 5 |

TABLE 9-continued

MYC Inhibitory Efficacy of DsiRNAs Assayed at 1 nM in Human A549 Cells and Mouse Hepa 1-6 Cells

| DsiRNA Name (Human MYC Target Location, NM_002467.4) | Mouse MYC Target Location (NM_010849.4) | Human A549 Cells % Remaining MYC mRNA ± % Error (Assay: Hs MYC 514-620 (FAM)) | Human A549 Cells % Remaining MYC mRNA ± % Error (Assay: Hs MYC 1227-1347 (MAX)) | Human A549 Cells % Remaining MYC mRNA ± % Error (Assay: Hs MYC 1771-1882 (MAX)) |
|---|---|---|---|---|
| MYC-2324 | 2374 | 124.6 ± 3.6 | 116.6 ± 5.2 | 89.6 ± 3.9 |
| MYC-2325 | 2375 | 111 ± 3.3 | 127.5 ± 2.8 | 88.8 ± 3 |
| MYC-2326 | 2376 | 122.9 ± 4 | 160.8 ± 6.3 | 122.7 ± 2.8 |
| MYC-2327 | 2377 | 117.7 ± 12.7 | 145.8 ± 14.4 | 110.8 ± 2.7 |
| MYC-2328 | 2378 | 115.6 ± 5.6 | 125.5 ± 8 | 101 ± 1.8 |
| MYC-2329 | 2379 | 127 ± 6.8 | 86.7 ± 32.9 | 98.1 ± 0.6 |
| MYC-2330 | 2380 | 104.8 ± 2.8 | 86.7 ± 2.8 | 90.7 ± 1.8 |
| MYC-2331 | 2381 | 107.4 ± 3.2 | 97.6 ± 4.7 | 94.9 ± 10.4 |
| MYC-2332 | 2382 | 115.8 ± 3.7 | 115 ± 5.9 | 99.7 ± 0.9 |
| MYC-2333 | 2383 | 96.4 ± 1.6 | 96.5 ± 11.9 | 94.2 |

TABLE 10

MYC Inhibitory Efficacy of DsiRNAs Assayed at 1 nM in Mouse Hepa 1-6 Cells

| DsiRNA Name (Human MYC Target Location, NM_002467.4) | Mouse MYC Target Location (NM_010849.4) | Mouse Hepa 1-6 Cells % Remaining MYC mRNA ± % Error (Assays: Mm MYC 539-663 (FAM)) | Mouse Hepa 1-6 Cells % Remaining MYC mRNA ± % Error (Assays: Mm MYC 1339-1428 (MAX)) | Mouse Hepa 1-6 Cells % Remaining MYC mRNA ± % Error (Assays: Mm MYC 1971-2062 (MAX)) |
|---|---|---|---|---|
| MYC-188 | 235 | 129.1 ± 12.1 | 175.7 ± 9.3 | 104.5 ± 12.9 |
| MYC-189 | 236 | 118.2 ± 2.3 | 152.2 ± 5.6 | 97.1 ± 1.8 |
| MYC-190 | 237 | 117.7 ± 2.5 | 127.1 ± 3.8 | 98.8 ± 4.4 |
| MYC-191 | 238 | 110.3 ± 5 | 118 ± 2.6 | 99.1 ± 3.2 |
| MYC-192 | 239 | 98.9 ± 4.1 | 98.8 ± 6.4 | 83.5 ± 3.8 |
| MYC-193 | 240 | 96.1 ± 1.9 | 102.6 ± 3.3 | 83.9 ± 0.9 |
| MYC-194 | 241 | 108.7 ± 3.5 | 119.6 ± 2.9 | 91.7 ± 4.2 |
| MYC-195 | 242 | 136.9 ± 25.9 | 140.2 ± 12.1 | 81.4 ± 8.1 |
| MYC-612 | 668 | 71.8 ± 4.6 | 122 ± 3.9 | 85.2 ± 2.1 |
| MYC-613 | 669 | 81.4 ± 2.1 | 114.2 ± 3.5 | 93.7 ± 3.1 |
| MYC-614 | 670 | 108.8 ± 5.9 | 113.5 ± 1.4 | 93.2 ± 2.3 |
| MYC-615 | 671 | 73.4 ± 8.7 | 76.9 ± 10.7 | 84.5 ± 2.6 |
| MYC-616 | 672 | 65.5 ± 2.8 | 66.3 ± 3.5 | 72.8 ± 3.9 |
| MYC-617 | 673 | 90.6 ± 1.6 | 96.3 ± 4.2 | 100.2 ± 2.1 |
| MYC-618 | 674 | 56.3 ± 1.1 | 81.1 ± 5.1 | 80.4 ± 2.3 |
| MYC-619 | 675 | 63.7 ± 2.5 | 99.1 ± 4 | 86 ± 2.4 |
| MYC-620 | 676 | 78.7 ± 9.9 | 125.9 ± 10.4 | 99 ± 0.8 |
| MYC-621 | 677 | 67.9 ± 5.9 | 155.1 ± 8.3 | 116.4 ± 5.9 |
| MYC-622 | 678 | 67 ± 3.5 | 239.3 ± 4.2 | 178.6 ± 7.7 |
| MYC-623 | 679 | 61.2 ± 5.9 | 99.6 ± 8.4 | 103 ± 5 |
| MYC-624 | 680 | 70.7 ± 4.1 | 77.3 ± 8.7 | 88.7 ± 3.4 |
| MYC-625 | 681 | 73.8 ± 4.9 | 74.3 ± 2.2 | 86.9 ± 3 |
| MYC-626 | 682 | 63.1 ± 6.8 | 68.6 ± 5.5 | 81 ± 3 |
| MYC-627 | 683 | 76.8 ± 8.6 | 81.3 ± 10.9 | 89 ± 2 |
| MYC-628 | 684 | 134.9 ± 10.7 | 175.8 ± 9.8 | 117.2 ± 6.7 |
| MYC-629 | 685 | 89.3 ± 2.5 | 122.8 ± 5.1 | 80.4 ± 2.2 |
| MYC-733 | 789 | 69.2 ± 2 | 95.3 ± 4.3 | 75.2 ± 0.8 |
| MYC-734 | 790 | 72 ± 1.7 | 79.5 ± 2.6 | 75.7 ± 1.5 |
| MYC-735 | 791 | 92.8 ± 2.1 | 94.7 ± 4 | 86.4 ± 1.7 |
| MYC-736 | 792 | 65.4 ± 2.6 | 76.9 ± 1.7 | 71.5 ± 2.4 |
| MYC-737 | 793 | 99.7 ± 3.7 | 121.4 ± 4.8 | 88.4 ± 5.5 |
| MYC-738 | 794 | 139.9 ± 21 | 158.8 ± 20.7 | 83 ± 6.2 |
| MYC-739 | 795 | 97.7 ± 4.5 | 135.9 ± 1.3 | 96.7 ± 1 |
| MYC-740 | 796 | 99.9 ± 3.6 | 122.7 ± 4.3 | 94.6 ± 1.8 |
| MYC-741 | 797 | 84 ± 8.4 | 78.3 ± 20 | 85 ± 4.7 |
| MYC-742 | 798 | 66.4 ± 4.3 | 83 ± 1.3 | 83.8 ± 2.7 |
| MYC-743 | 799 | 89.6 ± 2 | 90.5 ± 2.9 | 96 ± 1.1 |
| MYC-784 | 840 | 85.3 ± 3.9 | 91.7 ± 5.1 | 83.3 ± 0.8 |
| MYC-785 | 841 | 89.7 ± 2.7 | 106.1 ± 4.5 | 89.5 ± 0.9 |
| MYC-786 | 842 | 96.6 ± 1.6 | 111.9 ± 3.8 | 90.5 ± 2.2 |
| MYC-787 | 843 | 105.1 ± 4.1 | 131.5 ± 7.8 | 111 ± 0.8 |

TABLE 10-continued

MYC Inhibitory Efficacy of DsiRNAs Assayed at 1 nM in Mouse Hepa 1-6 Cells

| DsiRNA Name (Human MYC Target Location, NM_002467.4) | Mouse MYC Target Location (NM_010849.4) | Mouse Hepa 1-6 Cells % Remaining MYC mRNA ± % Error (Assays: Mm MYC 539-663 (FAM)) | Mouse Hepa 1-6 Cells % Remaining MYC mRNA ± % Error (Assays: Mm MYC 1339-1428 (MAX)) | Mouse Hepa 1-6 Cells % Remaining MYC mRNA ± % Error (Assays: Mm MYC 1971-2062 (MAX)) |
|---|---|---|---|---|
| MYC-788 | 844 | 107.6 ± 4.7 | 118.2 ± 5.5 | 101.6 ± 5.2 |
| MYC-913 | 972 | 57.9 ± 4 | 74.3 ± 3.7 | 82.7 ± 6.8 |
| MYC-914 | 973 | 71.1 ± 6.5 | 69.9 ± 5 | 90.3 ± 5.1 |
| MYC-915 | 974 | 85.2 ± 1.4 | 81.6 ± 1.2 | 86.8 ± 0.7 |
| MYC-916 | 975 | 81.9 ± 2.6 | 79 ± 2.9 | 85.3 ± 3.8 |
| MYC-917 | 976 | 69.6 ± 2.6 | 74.1 ± 3.5 | 82.1 ± 3.5 |
| MYC-952 | 1011 | 49.6 ± 1.9 | 65.1 ± 3.9 | 69.6 ± 2 |
| MYC-953 | 1012 | 37.7 ± 4.1 | 68.3 ± 7 | 44.7 ± 4.6 |
| MYC-973 | 1032 | 102.4 ± 3.6 | 126.9 ± 9.2 | 94.5 ± 2.3 |
| MYC-974 | 1033 | 125.1 ± 1.7 | 136.1 ± 4.3 | 90.7 ± 1.5 |
| MYC-975 | 1034 | 89.8 ± 6.6 | 93.4 ± 9.1 | 79.6 ± 3.4 |
| MYC-976 | 1035 | 86.3 ± 3.7 | 82.8 ± 3.8 | 78.4 ± 3.6 |
| MYC-977 | 1036 | 106 ± 5.4 | 115.3 ± 2.1 | 89.4 ± 2.4 |
| MYC-978 | 1037 | 99 ± 2.4 | 108.9 ± 2.1 | 81.4 ± 2.8 |
| MYC-979 | 1038 | 102.2 ± 7.2 | 120.2 ± 8.4 | 79.4 ± 6.9 |
| MYC-980 | 1039 | 101.2 ± 3.3 | 137.3 ± 6.5 | 90.7 ± 3 |
| MYC-981 | 1040 | 90.8 ± 3.6 | 111.5 ± 5.7 | 74 ± 0.9 |
| MYC-982 | 1041 | 93 ± 3.6 | 89.5 ± 4.4 | 71.8 ± 3.4 |
| MYC-983 | 1042 | 102.3 ± 1.6 | 96.3 ± 4.3 | 83.3 ± 1.4 |
| MYC-984 | 1043 | 98.3 ± 2.1 | 86.4 ± 2.6 | 82.1 ± 1.1 |
| MYC-985 | 1044 | 96.8 ± 4 | 96.8 ± 7 | 82 ± 4.8 |
| MYC-986 | 1045 | 96.1 ± 6.2 | 98.4 ± 9.3 | 77.1 ± 3.1 |
| MYC-1033 | 1092 | 91 ± 13.7 | 104.3 ± 23.2 | 80.5 ± 7 |
| MYC-1034 | 1093 | 69.3 ± 4.6 | 86.7 ± 7.1 | 67.8 ± 1.9 |
| MYC-1035 | 1094 | 99.1 ± 5.3 | 111.7 ± 8 | 92 ± 7.6 |
| MYC-1036 | 1095 | 112.5 ± 2.6 | 101.7 ± 6.2 | 90.7 ± 1.7 |
| MYC-1037 | 1096 | 122.1 ± 2.4 | 101.7 ± 3.8 | 116 ± 2.3 |
| MYC-1038 | 1097 | 101.7 ± 3.7 | 90.9 ± 3.4 | 87.6 ± 2.2 |
| MYC-1039 | 1098 | 93.4 ± 3 | 85.8 ± 2.2 | 84.9 ± 2.9 |
| MYC-1040 | 1099 | 93.4 ± 4.6 | 83 ± 8.6 | 87.7 ± 2.9 |
| MYC-1041 | 1100 | 70.6 ± 4.7 | 62.5 ± 7.4 | 76.1 ± 3.3 |
| MYC-1042 | 1101 | 115.5 ± 6.6 | 161.8 ± 7.5 | 110.7 ± 7 |
| MYC-1043 | 1102 | 149.5 ± 2.7 | 184.3 ± 6.8 | 128.7 ± 1.3 |
| MYC-1044 | 1103 | 127.6 ± 4.6 | 232.3 ± 8.5 | 136.8 ± 4.5 |
| MYC-1045 | 1104 | 106.6 ± 2.7 | 279.5 ± 8 | 156.8 ± 4.4 |
| MYC-1046 | 1105 | 106.6 ± 7.8 | 445.6 ± 15.4 | 229.5 ± 6.9 |
| MYC-1047 | 1106 | 118.2 ± 5.7 | 173 ± 6.7 | 128.8 ± 5.5 |
| MYC-1048 | 1107 | 109 ± 2.4 | 130 ± 3.9 | 95.8 ± 2.1 |
| MYC-1049 | 1108 | 107.1 ± 5.1 | 133.6 ± 5.4 | 104.7 ± 2.3 |
| MYC-1050 | 1109 | 70.4 ± 5.1 | 146.1 ± 6.6 | 111 ± 3.8 |
| MYC-1051 | 1110 | 97.3 ± 3.9 | 115.3 ± 3.9 | 99.6 ± 1.4 |
| MYC-1052 | 1111 | 95.6 ± 2.5 | 105.2 ± 2 | 90 ± 7.1 |
| MYC-1053 | 1112 | 113.4 ± 2.8 | 116.8 ± 4 | 104 ± 4 |
| MYC-1096 | 1155 | 99.6 ± 1.7 | 132.5 ± 5.5 | 107 ± 5 |
| MYC-1097 | 1156 | 89.1 ± 3.8 | 188.9 ± 5 | 120.8 ± 3 |
| MYC-1098 | 1157 | 68.4 ± 3.5 | 215.7 ± 3.1 | 117 ± 5.6 |
| MYC-1099 | 1158 | 68.9 ± 6.9 | 123.2 ± 9.3 | 91.1 ± 6.4 |
| MYC-1100 | 1159 | 75.2 ± 1.6 | 212 ± 4.4 | 109.6 ± 1.2 |
| MYC-1101 | 1160 | 101.3 ± 4.5 | 132.7 ± 1.3 | 74.8 ± 33 |
| MYC-1189 | 1248 | 136.1 ± 5.6 | 168.5 ± 11.1 | 115.9 ± 11.5 |
| MYC-1190 | 1249 | 95.8 ± 5.8 | 166.8 ± 6.8 | 116.4 ± 4.4 |
| MYC-1191 | 1250 | 109.7 ± 9.1 | 647.4 ± 6.4 | 213.7 ± 9.8 |
| MYC-1192 | 1251 | 105.8 ± 9 | 589.1 ± 9.1 | 221.4 ± 13.9 |
| MYC-1193 | 1252 | 96.9 ± 3.6 | 238.3 ± 5 | 126.7 ± 4.4 |
| MYC-1315 | 1371 | 96.3 ± 7.6 | 92.2 ± 12.2 | 107.4 ± 6.4 |
| MYC-1316 | 1372 | 110 ± 8.2 | 136 ± 6 | 111 ± 5 |
| MYC-1317 | 1373 | 100.9 ± 2.9 | 107.1 ± 2.9 | 103.2 ± 5.6 |
| MYC-1318 | 1374 | 104.2 ± 2.4 | 116.2 ± 3.6 | 99 ± 2.9 |
| MYC-1319 | 1375 | 94.4 ± 3.2 | 86.5 ± 5.5 | 90.1 ± 1.4 |
| MYC-1320 | 1376 | 96.6 ± 2.6 | 79.7 ± 1.2 | 104 ± 2.2 |
| MYC-1321 | 1377 | 96.7 ± 3.7 | 103.6 ± 4.9 | 93.5 ± 2.3 |
| MYC-1322 | 1378 | 106.8 ± 2.8 | 115.6 ± 4.5 | 97.6 ± 3.1 |
| MYC-1323 | 1379 | 107.8± | 115.6± | 86.8± |
| MYC-1324 | 1380 | 112.1 ± 2.7 | 139.1 ± 0.9 | 108.1 ± 2.5 |
| MYC-1325 | 1381 | 103.3 ± 2.2 | 120.6 ± 2.5 | 100.5 ± 4.1 |
| MYC-1326 | 1382 | 86 ± 3.9 | 66 ± 15.6 | 85 ± 2.3 |
| MYC-1327 | 1383 | 77.4 ± 8.3 | 68.4 ± 8.8 | 82.2 ± 5.9 |
| MYC-1328 | 1384 | 76.4 ± 2.2 | 70.5 ± 2.3 | 78 ± 1.7 |
| MYC-1329 | 1385 | 77.6 ± 7.1 | 78.1 ± 5.2 | 89.1 ± 8.3 |

TABLE 10-continued

MYC Inhibitory Efficacy of DsiRNAs Assayed at 1 nM in Mouse Hepa 1-6 Cells

| DsiRNA Name (Human MYC Target Location, NM_002467.4) | Mouse MYC Target Location (NM_010849.4) | Mouse Hepa 1-6 Cells % Remaining MYC mRNA ± % Error (Assays: Mm MYC 539-663 (FAM)) | Mouse Hepa 1-6 Cells % Remaining MYC mRNA ± % Error (Assays: Mm MYC 1339-1428 (MAX)) | Mouse Hepa 1-6 Cells % Remaining MYC mRNA ± % Error (Assays: Mm MYC 1971-2062 (MAX)) |
|---|---|---|---|---|
| MYC-1330 | 1386 | 75.2 ± 6.7 | 80.2 ± 7.2 | 79.9 ± 2.5 |
| MYC-1331 | 1387 | 88.8 ± 5.3 | 94.7 ± 7.5 | 83 ± 5.1 |
| MYC-1332 | 1388 | 74 ± 4.7 | 84.2 ± 5.9 | 94.4 ± 3.2 |
| MYC-1333 | 1389 | 65.1 ± 0.9 | 59.5 ± 2.2 | 108 ± 3 |
| MYC-1334 | 1390 | 66.3 ± 4.8 | 62 ± 4.1 | 76.1 ± 3.6 |
| MYC-1360 | 1416 | 41.6 ± 3.5 | 35 ± 2.5 | 55.3 ± 1.9 |
| MYC-1361 | 1417 | 55.7 ± 2.2 | 54.8 ± 3.1 | 62.1 ± 2.2 |
| MYC-1448 | 1504 | 83.1 ± 6.2 | 89.6 ± 4.2 | 87.5 ± 1.8 |
| MYC-1468 | 1524 | 50.2 ± 2.1 | 47.6 ± 1.6 | 99.5 ± 2.1 |
| MYC-1469 | 1525 | 68.8 ± 4.8 | 64.9 ± 10.8 | 72.5 ± 5.1 |
| MYC-1470 | 1526 | 98.5 ± 7.5 | 93 ± 10 | 76.6 ± 5.7 |
| MYC-1471 | 1527 | 110.8 ± 5.6 | 120.5 ± 5.9 | 84.9 ± 3.8 |
| MYC-1472 | 1528 | 107.2 ± 6.1 | 107.9 ± 6.8 | 82 ± 5 |
| MYC-1473 | 1529 | 101.3 ± 9.3 | 97.1 ± 7.4 | 83.5 ± 6.7 |
| MYC-1474 | 1530 | 97.4 ± 1.9 | 88.8 ± 2.7 | 81.1 ± 3.6 |
| MYC-1475 | 1531 | 128.5 ± 5.3 | 132.9 ± 6.6 | 101.6 ± 4.5 |
| MYC-1476 | 1532 | 91.9 ± 6 | 90.8 ± 6.4 | 85.2 ± 4.7 |
| MYC-1477 | 1533 | 93.6 ± 11.7 | 93 ± 7.1 | 93.7 ± 10.2 |
| MYC-1478 | 1534 | 97.6 ± 9.9 | 109.2 ± 8.8 | 90.6 ± 12 |
| MYC-1479 | 1535 | 102.8 ± 1.9 | 105.9 ± 3.7 | 105.3 ± 3.1 |
| MYC-1480 | 1536 | 93.9 ± 5.8 | 90.2 ± 8.8 | 96.1 ± 10.2 |
| MYC-1481 | 1537 | 112.4 ± 8 | 111.7 ± 5 | 102.7 ± 8.2 |
| MYC-1482 | 1538 | 92.3 ± 10.9 | 88.8 ± 13.6 | 169 ± 12.9 |
| MYC-1483 | 1539 | 65 ± 14 | 61.4 ± 13.9 | 207 ± 14.3 |
| MYC-1711 | 1767 | 59.9 ± 1.7 | 58.3 ± 4.8 | 180.3 ± 9.3 |
| MYC-1712 | 1768 | 56.5 ± 3 | 57.6 ± 2.2 | 175.4 ± 6.7 |
| MYC-1713 | 1769 | 86.2 ± 3.7 | 97 ± 3.8 | 92.6 ± 2.6 |
| MYC-1714 | 1770 | 104.4 ± 4.7 | 110.1 ± 3.2 | 92.4 ± 3.4 |
| MYC-1715 | 1771 | 98.9 ± 5.3 | 97.4 ± 6.9 | 89.8 ± 3.5 |
| MYC-1716 | 1772 | 103.2 ± 1.6 | 89.7 ± 2.5 | 92.1 ± 2.2 |
| MYC-1717 | 1773 | 105.9 ± 4.7 | 85.3 ± 3.9 | 102.7 ± 1.9 |
| MYC-1718 | 1774 | 140.1 ± 12.4 | 152.3 ± 14.2 | 98.7 ± 5.6 |
| MYC-1719 | 1775 | 122.6 ± 5.6 | 118.9 ± 8.4 | 101.4 ± 3.8 |
| MYC-1720 | 1776 | 82.9± | 82.9± | 72.9± |
| MYC-1721 | 1777 | 108.3 ± 5.7 | 157.7 ± 6.4 | 103.2 ± 6.7 |
| MYC-1856 | 1912 | 66.5 ± 4.3 | 86.9 ± 2.9 | 75.2 ± 4.8 |
| MYC-1857 | 1913 | 60.9 ± 5.7 | 68 ± 7.2 | 74.6 ± 2 |
| MYC-2115 | 2195 | 79.7 ± 3.2 | 84.2 ± 1.8 | 54.3 ± 2.7 |
| MYC-2116 | 2196 | 96.7 ± 3.5 | 100.2 ± 3.9 | 77 ± 3 |
| MYC-2193 | 2273 | 101.9 ± 2.4 | 112.2 ± 2.8 | 92.3 ± 1 |
| MYC-2194 | 2274 | 115.9 ± 4.1 | 143.8 ± 1.8 | 102.5 ± 2.8 |
| MYC-2195 | 2275 | 140.5 ± 20.6 | 175.2 ± 23.4 | 74.1 ± 5.9 |
| MYC-2196 | 2276 | 89 ± 2.5 | 133.5 ± 4 | 50.5 ± 3.7 |
| MYC-2197 | 2277 | 79.2 ± 1.7 | 98.3 ± 5 | 56.3 ± 1.7 |
| MYC-2198 | 2278 | 104.9 ± 8.5 | 129.9 ± 4.6 | 96.4 ± 2.4 |
| MYC-2199 | 2279 | 68.5 ± 8.7 | 69.4 ± 4.6 | 54.7 ± 2.1 |
| MYC-2200 | 2280 | 79.8 ± 1.7 | 80.1 ± 1.8 | 73.1 ± 1.9 |
| MYC-2201 | 2281 | 74.3 ± 2.3 | 80.5 ± 1.8 | 63.5 ± 1.2 |
| MYC-2202 | 2282 | 92.6 ± 2.4 | 106.6 ± 6.4 | 81.2 ± 2 |
| MYC-2203 | 2283 | 98.4 ± 3.2 | 116.2 ± 2.5 | 86.4 ± 2.9 |
| MYC-2204 | 2284 | 100.3 ± 1.3 | 134.4 ± 1.3 | 98.2 ± 6.2 |
| MYC-2205 | 2285 | 82.8 ± 5.4 | 91.1 ± 7 | 69.7 ± 5.6 |
| MYC-2313 | 2363 | 95.7 ± 4.3 | 90.2 ± 6.2 | 91.8 ± 0.8 |
| MYC-2314 | 2364 | 96.8 ± 5 | 84.5 ± 5.6 | 85.4 ± 5.9 |
| MYC-2315 | 2365 | 108.3 ± 8.4 | 100.9 ± 8.7 | 104.6 ± 3.4 |
| MYC-2316 | 2366 | 112.2 ± 4.1 | 104.2 ± 4.1 | 105 ± 2.5 |
| MYC-2317 | 2367 | 99.6 ± 2.9 | 102.5 ± 2.8 | 98.4 ± 3.8 |
| MYC-2318 | 2368 | 94.5 ± 5.5 | 96.2 ± 7.1 | 90 ± 6 |
| MYC-2319 | 2369 | 123.4 ± 5.2 | 182.8 ± 6.8 | 106.4 ± 10.7 |
| MYC-2320 | 2370 | 108.6 ± 4.6 | 147.1 ± 3 | 88.7 ± 5.2 |
| MYC-2321 | 2371 | 89.6 ± 3.2 | 103.8 ± 5.9 | 67.7 ± 1.7 |
| MYC-2322 | 2372 | 81 ± 1.3 | 86 ± 1.2 | 75.1 ± 1.5 |
| MYC-2323 | 2373 | 84.3 ± 2.5 | 85.5 ± 5.5 | 78.3 ± 2.6 |
| MYC-2324 | 2374 | 116.3 ± 2.9 | 137.2 ± 3.9 | 107 ± 4.3 |
| MYC-2325 | 2375 | 117 ± 6.5 | 147.2 ± 3.4 | 101.3 ± 2.4 |
| MYC-2326 | 2376 | 119.8 ± 6.4 | 154.9 ± 2.1 | 98.9 ± 2.3 |
| MYC-2327 | 2377 | 115.9 ± 4.5 | 162.4 ± 3.4 | 105 ± 1.9 |
| MYC-2328 | 2378 | 123.1 ± 0.9 | 150.5 ± 3.5 | 111.8 ± 1 |
| MYC-2329 | 2379 | 119.8 ± 8.1 | 125.5 ± 6.5 | 102.5 ± 3.4 |

TABLE 10-continued

MYC Inhibitory Efficacy of DsiRNAs Assayed at 1 nM in Mouse Hepa 1-6 Cells

| DsiRNA Name (Human MYC Target Location, NM_002467.4) | Mouse MYC Target Location (NM_010849.4) | Mouse Hepa 1-6 Cells % Remaining MYC mRNA ± % Error (Assays: Mm MYC 539-663 (FAM)) | Mouse Hepa 1-6 Cells % Remaining MYC mRNA ± % Error (Assays: Mm MYC 1339-1428 (MAX)) | Mouse Hepa 1-6 Cells % Remaining MYC mRNA ± % Error (Assays: Mm MYC 1971-2062 (MAX)) |
|---|---|---|---|---|
| MYC-2330 | 2380 | 105 ± 1.7 | 106.1 ± 1.6 | 96.8 ± 3.5 |
| MYC-2331 | 2381 | 108.7 ± 4.1 | 99.5 ± 6.2 | 99.4 ± 3.5 |
| MYC-2332 | 2382 | 111.3 ± 2.5 | 123.9 ± 6.5 | 109.6 ± 4.3 |
| MYC-2333 | 2383 | 108.7 ± 1.4 | 130.4 ± 6.8 | 99.1 ± 1.3 |
| | MYC-m187 | 129.1 ± 12.1 | 175.7 ± 9.3 | 119.3 ± 3.6 |
| | MYC-m194 | 118.2 ± 2.3 | 152.2 ± 5.6 | 109.2 ± 6.7 |
| | MYC-m199 | 117.7 ± 2.5 | 127.1 ± 3.8 | 94.1 ± 9.2 |
| | MYC-m210 | 110.3 ± 5 | 118 ± 2.6 | 120.7 ± 8.4 |
| | MYC-m223 | 98.9 ± 4.1 | 98.8 ± 6.4 | 123.6 ± 1.9 |
| | MYC-m265 | 96.1 ± 1.9 | 102.6 ± 3.3 | 72.4 ± 3.4 |
| | MYC-m273 | 108.7 ± 3.5 | 119.6 ± 2.9 | 117 ± 3.7 |
| | MYC-m321 | 136.9 ± 25.9 | 140.2 ± 12.1 | 86.1 ± 6.8 |
| | MYC-m384 | 71.8 ± 4.6 | 122 ± 3.9 | 100.9 ± 1.2 |
| | MYC-m455 | 81.4 ± 2.1 | 114.2 ± 3.5 | 79.3 ± 4 |
| | MYC-m460 | 108.8 ± 5.9 | 113.5 ± 1.4 | 75.1 ± 3.2 |
| | MYC-m469 | 73.4 ± 8.7 | 76.9 ± 10.7 | 85.3 ± 7.1 |
| | MYC-m478 | 65.5 ± 2.8 | 66.3 ± 3.5 | 202.5 ± 5.2 |
| | MYC-m581 | 90.6 ± 1.6 | 96.3 ± 4.2 | 64.6 ± 3.1 |
| | MYC-m591 | 56.3 ± 1.1 | 81.1 ± 5.1 | 92.5 ± 2.4 |
| | MYC-m597 | 63.7 ± 2.5 | 99.1 ± 4 | 81 ± 3.2 |
| | MYC-m609 | 78.7 ± 9.9 | 125.9 ± 10.4 | 78.7 ± 1.6 |
| | MYC-m657 | 67.9 ± 5.9 | 155.1 ± 8.3 | 75.6 ± 2.5 |
| | MYC-m663 | 67 ± 3.5 | 239.3 ± 4.2 | 106.2 ± 3 |
| | MYC-m699 | 61.2 ± 5.9 | 99.6 ± 8.4 | 106.2 ± 0.7 |
| | MYC-m724 | 70.7 ± 4.1 | 77.3 ± 8.7 | 58.1 ± 4.7 |
| | MYC-m732 | 73.8 ± 4.9 | 74.3 ± 2.2 | 97.6 ± 5.1 |
| | MYC-m787 | 63.1 ± 6.8 | 68.6 ± 5.5 | 89.9 ± 5.3 |
| | MYC-m800 | 76.8 ± 8.6 | 81.3 ± 10.9 | 65.6 ± 7.3 |
| | MYC-m852 | 134.9 ± 10.7 | 175.8 ± 9.8 | 82.5 ± 1.4 |
| | MYC-m857 | 89.3 ± 2.5 | 122.8 ± 5.1 | 74.3 ± 1.9 |
| | MYC-m867 | 69.2 ± 2 | 95.3 ± 4.3 | 107.5 ± 1.4 |
| | MYC-m873 | 72 ± 1.7 | 79.5 ± 2.6 | 104.5 ± 6.6 |
| | MYC-m940 | 92.8 ± 2.1 | 94.7 ± 4 | 76.3 ± 6.4 |
| | MYC-m948 | 65.4 ± 2.6 | 76.9 ± 1.7 | 153.4 ± 11.4 |
| | MYC-m956 | 99.7 ± 3.7 | 121.4 ± 4.8 | 124.6 ± 3 |
| | MYC-m964 | 139.9 ± 21 | 158.8 ± 20.7 | 89.3 ± 2.8 |
| | MYC-m969 | 97.7 ± 4.5 | 135.9 ± 1.3 | 107.6 ± 6.3 |
| | MYC-m980 | 99.9 ± 3.6 | 122.7 ± 4.3 | 99.1 ± 4.1 |
| | MYC-m989 | 84 ± 8.4 | 78.3 ± 20 | 84.2 ± 7.1 |
| | MYC-m994 | 66.4 ± 4.3 | 83 ± 1.3 | 79.2 ± 4.9 |
| | MYC-m1000 | 89.6 ± 2 | 90.5 ± 2.9 | 80.2 ± 0.4 |
| | MYC-m1006 | 85.3 ± 3.9 | 91.7 ± 5.1 | 90.1 ± 3.4 |
| | MYC-m1014 | 89.7 ± 2.7 | 106.1 ± 4.5 | 70.4 ± 2.6 |
| | MYC-m1020 | 96.6 ± 1.6 | 111.9 ± 3.8 | 75.1 ± 5.2 |
| | MYC-m1029 | 105.1 ± 4.1 | 131.5 ± 7.8 | 79.5 ± 4.5 |
| | MYC-m1046 | 107.6 ± 4.7 | 118.2 ± 5.5 | 77.8 ± 6.3 |
| | MYC-m1164 | 57.9 ± 4 | 74.3 ± 3.7 | 105.1 ± 1.5 |
| | MYC-m1170 | 71.1 ± 6.5 | 69.9 ± 5 | 80.3 ± 1.4 |
| | MYC-m1176 | 85.2 ± 1.4 | 81.6 ± 1.2 | 90.8 ± 5.1 |
| | MYC-m1258 | 81.9 ± 2.6 | 79 ± 2.9 | 88.4 ± 1.6 |
| | MYC-m1269 | 69.6 ± 2.6 | 74.1 ± 3.5 | 63.5 ± 1.1 |
| | MYC-m1391 | 49.6 ± 1.9 | 65.1 ± 3.9 | 100.5 ± 2.2 |
| | MYC-m1396 | 37.7 ± 4.1 | 68.3 ± 7 | 67.5 ± 4.1 |
| | MYC-m1402 | 102.4 ± 3.6 | 126.9 ± 9.2 | 93.2 ± 2.7 |
| | MYC-m1407 | 125.1 ± 1.7 | 136.1 ± 4.3 | 77.4 ± 6.6 |
| | MYC-m1414 | 89.8 ± 6.6 | 93.4 ± 9.1 | 90.3 ± 1.9 |
| | MYC-m1420 | 86.3 ± 3.7 | 82.8 ± 3.8 | 58.5 ± 2.2 |
| | MYC-m1426 | 106 ± 5.4 | 115.3 ± 2.1 | 58.5 ± 2.9 |
| | MYC-m1431 | 99 ± 2.4 | 108.9 ± 2.1 | 103.9 ± 3 |
| | MYC-m1437 | 102.2 ± 7.2 | 120.2 ± 8.4 | 83.5 ± 5.2 |
| | MYC-m1443 | 101.2 ± 3.3 | 137.3 ± 6.5 | 82.6 ± 2.2 |
| | MYC-m1470 | 90.8 ± 3.6 | 111.5 ± 5.7 | 84.7 ± 2.2 |
| | MYC-m1541 | 93 ± 3.6 | 89.5 ± 4.4 | 82.5 ± 2.7 |
| | MYC-m1554 | 102.3 ± 1.6 | 96.3 ± 4.3 | 117.3 ± 3.5 |
| | MYC-m1614 | 98.3 ± 2.1 | 86.4 ± 2.6 | 91.7 ± 4.6 |
| | MYC-m1619 | 96.8 ± 4 | 96.8 ± 7 | 94.7 ± 3.5 |
| | MYC-m1627 | 96.1 ± 6.2 | 98.4 ± 9.3 | 89.7 ± 4.1 |
| | MYC-m1632 | 91 ± 13.7 | 104.3 ± 23.2 | 84.7 ± 5 |
| | MYC-m1638 | 69.3 ± 4.6 | 86.7 ± 7.1 | 75.9 ± 4.4 |

TABLE 10-continued

MYC Inhibitory Efficacy of DsiRNAs Assayed at 1 nM in Mouse Hepa 1-6 Cells

| DsiRNA Name (Human MYC Target Location, NM_002467.4) | Mouse MYC Target Location (NM_010849.4) | Mouse Hepa 1-6 Cells % Remaining MYC mRNA ± % Error (Assays: Mm MYC 539-663 (FAM)) | Mouse Hepa 1-6 Cells % Remaining MYC mRNA ± % Error (Assays: Mm MYC 1339-1428 (MAX)) | Mouse Hepa 1-6 Cells % Remaining MYC mRNA ± % Error (Assays: Mm MYC 1971-2062 (MAX)) |
|---|---|---|---|---|
| | MYC-m1644 | 99.1 ± 5.3 | 111.7 ± 8 | 91.6 ± 5.4 |
| | MYC-m1649 | 112.5 ± 2.6 | 101.7 ± 6.2 | 84.2 ± 5.3 |
| | MYC-m1754 | 122.1 ± 2.4 | 101.7 ± 3.8 | 58.2 ± 1.5 |
| | MYC-m1765 | 101.7 ± 3.7 | 90.9 ± 3.4 | 117.2 ± 2.6 |
| | MYC-m1778 | 93.4 ± 3 | 85.8 ± 2.2 | 75.2 ± 2 |
| | MYC-m1786 | 93.4 ± 4.6 | 83 ± 8.6 | 72.7 ± 3.2 |
| | MYC-m1795 | 70.6 ± 4.7 | 62.5 ± 7.4 | 152.9 ± 2.9 |
| | MYC-m1825 | 115.5 ± 6.6 | 161.8 ± 7.5 | 59.4 ± 1.8 |
| | MYC-m1838 | 149.5 ± 2.7 | 184.3 ± 6.8 | 103.5 ± 10.7 |
| | MYC-m1845 | 127.6 ± 4.6 | 232.3 ± 8.5 | 82.3 ± 2.5 |
| | MYC-m1850 | 106.6 ± 2.7 | 279.5 ± 8 | 62.5 ± 0.6 |
| | MYC-m1855 | 106.6 ± 7.8 | 445.6 ± 15.4 | 88 ± 8.2 |
| | MYC-m1860 | 118.2 ± 5.7 | 173 ± 6.7 | 62.6 ± 2.7 |
| | MYC-m1873 | 109 ± 2.4 | 130 ± 3.9 | 95.9 ± 8.8 |
| | MYC-m1879 | 107.1 ± 5.1 | 133.6 ± 5.4 | 79.1 ± 1.2 |
| | MYC-m1887 | 70.4 ± 5.1 | 146.1 ± 6.6 | 81.3 ± 10.7 |
| | MYC-m1896 | 97.3 ± 3.9 | 115.3 ± 3.9 | 74.7 ± 1.7 |
| | MYC-m1910 | 95.6 ± 2.5 | 105.2 ± 2 | 85.1 ± 7 |
| | MYC-m1938 | 113.4 ± 2.8 | 116.8 ± 4 | 102.5 ± 2 |
| | MYC-m1943 | 99.6 ± 1.7 | 132.5 ± 5.5 | 64.9 ± 4.5 |
| | MYC-m1951 | 89.1 ± 3.8 | 188.9 ± 5 | 82 ± 2.4 |
| | MYC-m1957 | 68.4 ± 3.5 | 215.7 ± 3.1 | 75.8 ± 2.3 |
| | MYC-m1963 | 68.9 ± 6.9 | 123.2 ± 9.3 | 157.9 ± 3.4 |
| | MYC-m1985 | 75.2 ± 1.6 | 212 ± 4.4 | 64.8 ± 3.6 |
| | MYC-m1995 | 101.3 ± 4.5 | 132.7 ± 1.3 | 58.3 ± 3.5 |
| | MYC-m2002 | 136.1 ± 5.6 | 168.5 ± 11.1 | 59.2 ± 1.9 |
| | MYC-m2011 | 95.8 ± 5.8 | 166.8 ± 6.8 | 65.5 ± 2.5 |
| | MYC-m2016 | 109.7 ± 9.1 | 647.4 ± 6.4 | 46.1 ± 1.2 |
| | MYC-m2021 | 105.8 ± 9 | 589.1 ± 9.1 | 67.4 ± 2.4 |
| | MYC-m2034 | 96.9 ± 3.6 | 238.3 ± 5 | 48 ± 1.4 |
| | MYC-m2039 | 96.3 ± 7.6 | 92.2 ± 12.2 | 38.1 ± 1.9 |
| | MYC-m2044 | 110 ± 8.2 | 136 ± 6 | 55.9 ± 2.3 |
| | MYC-m2049 | 100.9 ± 2.9 | 107.1 ± 2.9 | 53.5 ± 3.5 |
| | MYC-m2056 | 104.2 ± 2.4 | 116.2 ± 3.6 | 54.1 ± 2.5 |
| | MYC-m2064 | 94.4 ± 3.2 | 86.5 ± 5.5 | 43.8 ± 3.6 |
| | MYC-m2069 | 96.6 ± 2.6 | 79.7 ± 1.2 | 47.6 ± 4.6 |
| | MYC-m2096 | 96.7 ± 3.7 | 103.6 ± 4.9 | 59.8 ± 2 |
| | MYC-m2103 | 106.8 ± 2.8 | 115.6 ± 4.5 | 51.9 ± 3.8 |
| | MYC-m2110 | 107.8± | 115.6± | 39.9 ± 2 |
| | MYC-m2117 | 112.1 ± 2.7 | 139.1 ± 0.9 | 49 ± 5.8 |
| | MYC-m2125 | 103.3 ± 2.2 | 120.6 ± 2.5 | 46.5 ± 1.9 |
| | MYC-m2131 | 86 ± 3.9 | 66 ± 15.6 | 47.7 ± 2.8 |
| | MYC-m2136 | 77.4 ± 8.3 | 68.4 ± 8.8 | 41.3 ± 1.8 |
| | MYC-m2143 | 76.4 ± 2.2 | 70.5 ± 2.3 | 70.9 ± 3.1 |
| | MYC-m2149 | 77.6 ± 7.1 | 78.1 ± 5.2 | 87.2 ± 3.7 |
| | MYC-m2154 | 75.2 ± 6.7 | 80.2 ± 7.2 | 74.1 ± 4.9 |
| | MYC-m2159 | 88.8 ± 5.3 | 94.7 ± 7.5 | 47.8 ± 3.3 |
| | MYC-m2166 | 74 ± 4.7 | 84.2 ± 5.9 | 48.2 ± 7.2 |
| | MYC-m2171 | 65.1 ± 0.9 | 59.5 ± 2.2 | 49.1 ± 2.1 |
| | MYC-m2177 | 66.3 ± 4.8 | 62 ± 4.1 | 59.4 ± 4 |
| | MYC-m2187 | 41.6 ± 3.5 | 35 ± 2.5 | 65.1 ± 3.3 |
| | MYC-m2194 | 55.7 ± 2.2 | 54.8 ± 3.1 | 48 ± 1.5 |
| | MYC-m2200 | 83.1 ± 6.2 | 89.6 ± 4.2 | 49.9 ± 1.9 |
| | MYC-m2208 | 50.2 ± 2.1 | 47.6 ± 1.6 | 108.3 ± 6.6 |
| | MYC-m2217 | 68.8 ± 4.8 | 64.9 ± 10.8 | 114.8 ± 7.1 |
| | MYC-m2224 | 98.5 ± 7.5 | 93 ± 10 | 101.1 ± 4.3 |
| | MYC-m2229 | 110.8 ± 5.6 | 120.5 ± 5.9 | 51.8 ± 8.6 |
| | MYC-m2236 | 107.2 ± 6.1 | 107.9 ± 6.8 | 64.6 ± 5 |
| | MYC-m2241 | 101.3 ± 9.3 | 97.1 ± 7.4 | 52.2 ± 7.6 |
| | MYC-m2255 | 97.4 ± 1.9 | 88.8 ± 2.7 | 34.9 ± 9.8 |
| | MYC-m2260 | 128.5 ± 5.3 | 132.9 ± 6.6 | 69.4 ± 11.1 |
| | MYC-m2265 | 91.9 ± 6 | 90.8 ± 6.4 | 57.7 ± 4.7 |
| | MYC-m2270 | 93.6 ± 11.7 | 93 ± 7.1 | 51.6 ± 3.4 |
| | MYC-m2286 | 97.6 ± 9.9 | 109.2 ± 8.8 | 63.6 ± 1.9 |
| | MYC-m2291 | 102.8 ± 1.9 | 105.9 ± 3.7 | 82.1 ± 8.9 |
| | MYC-m2296 | 93.9 ± 5.8 | 90.2 ± 8.8 | 48.6 ± 3.2 |
| | MYC-m2305 | 112.4 ± 8 | 111.7 ± 5 | 84.9 ± 2.1 |
| | MYC-m2311 | 92.3 ± 10.9 | 88.8 ± 13.6 | 59 ± 9 |
| | MYC-m2317 | 65 ± 14 | 61.4 ± 13.9 | 63.4 ± 3.2 |

TABLE 10-continued

MYC Inhibitory Efficacy of DsiRNAs Assayed at 1 nM in Mouse Hepa 1-6 Cells

| DsiRNA Name (Human MYC Target Location, NM_002467.4) | Mouse MYC Target Location (NM_010849.4) | Mouse Hepa 1-6 Cells % Remaining MYC mRNA ± % Error (Assays: Mm MYC 539-663 (FAM)) | Mouse Hepa 1-6 Cells % Remaining MYC mRNA ± % Error (Assays: Mm MYC 1339-1428 (MAX)) | Mouse Hepa 1-6 Cells % Remaining MYC mRNA ± % Error (Assays: Mm MYC 1971-2062 (MAX)) |
|---|---|---|---|---|
| | MYC-m2324 | 59.9 ± 1.7 | 58.3 ± 4.8 | 69.4 ± 10.5 |
| | MYC-m2333 | 56.5 ± 3 | 57.6 ± 2.2 | 89.8 ± 2.9 |
| | MYC-m2338 | 86.2 ± 3.7 | 97 ± 3.8 | 92.1 ± 3.6 |
| | MYC-m2346 | 104.4 ± 4.7 | 110.1 ± 3.2 | 127.3 ± 4.8 |
| | MYC-m2351 | 98.9 ± 5.3 | 97.4 ± 6.9 | 100.2 ± 5.2 |
| | MYC-m2356 | 103.2 ± 1.6 | 89.7 ± 2.5 | 71.2 ± 1.4 |
| | MYC-m2362 | 105.9 ± 4.7 | 85.5 ± 3.9 | 92.5 ± 2.1 |
| | MYC-m2384 | 140.1 ± 12.4 | 152.3 ± 14.2 | 85.4 ± 6.1 |
| | MYC-m2390 | 122.6 ± 5.6 | 118.9 ± 8.4 | 93.9 ± 3.3 |
| | MYC-m2397 | 82.9 | 82.9 | 86 ± 2.6 |

As shown in above Table 9, 24 of the 327 assayed asymmetric DsiRNAs examined in human A549 cells reproducibly showed, on average, greater than 50% reduction of human MYC levels in A549 cells at 1 nM (MYC-607, MYC-1364, MYC-1370, MYC-1382, MYC-1457, MYC-1465, MYC-1698, MYC-1734, MYC-1769, MYC-1779, MYC-1795, MYC-1808, MYC-1823, MYC-1828, MYC-1845, MYC-1855, MYC-1882, MYC-1911, MYC-1931, MYC-2099, MYC-2120, MYC-2306, MYC-1360 and MYC-1468). Significant variability between assays performed in human cells was observed, with 28 different duplexes showing greater than 50% reduction in Myc levels by at least two of three assays performed (MYC-1116, MYC-1346, MYC-1351, MYC-1364, MYC-1370, MYC-1382, MYC-1457, MYC-1465, MYC-1584, MYC-1698, MYC-1734, MYC-1769, MYC-1779, MYC-1795, MYC-1808, MYC-1823, MYC-1828, MYC-1845, MYC-1855, MYC-1882, MYC-1911, MYC-1931, MYC-2306, MYC-1360, MYC-1468, MYC-1483, MYC-1711 and MYC-1712). Meanwhile, 47 different duplexes exhibited at least 50% reduction in human Myc levels by only one assay during primary screening: MYC-548, MYC-601, MYC-607, MYC-920, MYC-949, MYC-970, MYC-1111, MYC-1340, MYC-1555, MYC-1599, MYC-1639, MYC-1687, MYC-1850, MYC-1893, MYC-1921, MYC-1926, MYC-1944, MYC-1965, MYC-1970, MYC-1976, MYC-1981, MYC-1989, MYC-1994, MYC-2001, MYC-2006, MYC-2013, MYC-2026, MYC-2031, MYC-2040, MYC-2048, MYC-2066, MYC-2073, MYC-2083, MYC-2094, MYC-2099, MYC-2114, MYC-2120, MYC-2176, MYC-2188, MYC-2233, MYC-2300, MYC-622, MYC-952, MYC-953, MYC-1482, MYC-2115 and MYC-2196.

Significant variability between assays performed in mouse cells was also observed, with only three different duplexes showing greater than 50% reduction in Myc levels by at least two of three assays performed (MYC-953, MYC-1360 and MYC-2187). Meanwhile, 23 different duplexes exhibited at least 50% reduction in mouse Myc levels by only one assay: MYC-952, MYC-1468, MYC-m1391, MYC-m1396, MYC-m2016, MYC-m2034, MYC-m2039, MYC-m2064, MYC-m2069, MYC-m2110, MYC-m2117, MYC-m2125, MYC-m2131, MYC-m2136, MYC-m2159, MYC-m2166, MYC-m2171, MYC-m2194, MYC-m2200, MYC-m2208, MYC-m2255 and MYC-m2296.

Assay results of Tables 9 and 10 above were also plotted and are shown in FIGS. 2A to 2H.

Example 3

DsiRNA Inhibition of MYC—Secondary Screen 96 asymmetric DsiRNAs (92 targeting Hs MYC and 4 uniquely targeting Mm MYC) of the above experiment were then examined in a secondary assay ("Phase 2"), with results of such assays presented in histogram form in FIGS. 3A to 3H. Specifically, the 96 asymmetric DsiRNAs selected from the 327 tested above were assessed for inhibition of human MYC at 1 nM and 0.1 nM in duplicate in the environment of human A549 cells (FIGS. 3A to 3D). These 96 asymmetric DsiRNAs were also assessed for inhibition of mouse MYC at 1 nM and 0.1 nM in the environment of mouse Hepa 1-6 cells (FIGS. 3E to 3H). As shown in FIGS. 3A to 3D, a number of asymmetric DsiRNAs reproducibly exhibited significant human MYC inhibitory efficacies at sub-nanomolar concentrations when assayed in the environment of A549 cells. In addition, as shown in FIGS. 3E to 3H, a number of asymmetric DsiRNAs were identified to possess significant mouse MYC inhibitory efficacies at sub-nanomolar concentrations when assayed in the environment of mouse Hepa 1-6 cells. (Notably, DsiRNAs capable of significant MYC inhibition in both species, as well as DsiRNAs capable of either human MYC-specific or mouse MYC-specific inhibition were all identified.)

Example 4

Modified Forms of MYC-Targeting DsiRNAs Reduce MYC Levels In Vitro

24 MYC-targeting DsiRNAs (MYC-607, MYC-622, MYC-953, MYC-1360, MYC-1364, MYC-1370, MYC-1698, MYC-1711, MYC-1712, MYC-1769, MYC-1926, MYC-1931, MYC-1944, MYC-1965, MYC-1981, MYC-2040, MYC-2066, MYC-2099, MYC-2114, MYC-2115, MYC-2120, MYC-2176, MYC-2196 and MYC-2233) were prepared with 2'-O-methyl guide strand modification patterns "M17", "M35", "M48" and "M8" as shown above. For each of the 24 DsiRNA sequences, DsiRNAs possessing each of the four guide strand modification patterns M17, M35, M48 and M8 were assayed for MYC inhibition in human A549 cells at 1.0 nM and 0.1 nM (in duplicate) concentrations in the environment of the A549 cells. Results of these experiments are presented as histograms in FIGS. 4A-4D. These same duplexes were also assayed in mouse Hepa 1-6 cells, with corresponding results shown in FIGS. 4E-4H. In general, the 24 DsiRNA sequences exhibited a trend towards reduced efficacy of MYC inhibition as the extent of 2'-O-methyl modification of the guide strand increased. However, for many of the DsiRNA sequences examined, a modification pattern could be identified that allowed the DsiRNA to retain significant MYC inhibitory efficacy in vitro. It was also notable that a number of these DsiRNAs (e.g., MYC-1712, MYC-1931, MYC-1944, MYC-1965, MYC-2066, MYC-2114, MYC-2120 and MYC-2233) exhibited no apparent decline in MYC inhibitory efficacy in even the most highly modified states examined. Thus, such active modified DsiRNA sequences possess modification patterns believed to be capable of stabilizing such DsiRNAs and/or reducing immunogenicity of such DsiRNAs when therapeutically administered to a subject in vivo.

Example 5

Additionally Modified Forms of MYC-Targeting DsiRNAs Reduce MYC Levels In Vitro

19 MYC-targeting DsiRNAs (MYC-622, MYC-953, MYC-1364, MYC-1370, MYC-1698, MYC-1711, MYC-1769, MYC-1926, MYC-1931, MYC-1944, MYC-1965, MYC-2040, MYC-2066, MYC-2099, MYC-2115, MYC-2120, MYC-2176, MYC-2196 and MYC-2233) were prepared with both 2'-O-methyl passenger strand and guide strand modification patterns. For each of the 19 DsiRNA sequences, DsiRNAs possessing passenger strand modification patterns selected from SM12, SM14, SM24 and SM31 (referred to as simply "M12", "M14", "M24" and "M31" in FIGS. 5A-5F and 6A-6D, where the passenger strand modification pattern is the first modification pattern listed, followed by the guide strand modification pattern, e.g., "M12-M48" in FIGS. 5A-5F and 6A-6D indicates a duplex possessing passenger strand modification pattern "SM12" and guide strand modification pattern "M48") and guide strand modification patterns selected from M17, M35, M48 and M8 were assayed for MYC inhibition in human A549 cells at 1.0 nM and 0.1 nM (in duplicate) concentrations in the environment of the A549 cells. Results of these experiments are presented as histograms in FIGS. 5A-5F. As in Example 4 above, in general, the 19 DsiRNA sequences exhibited a trend towards reduced efficacy of MYC inhibition as the extent of 2'-O-methyl modification of both passenger and guide strands increased. However, for many of the DsiRNA sequences examined, a combination of passenger and guide strand modification patterns could be identified that allowed the DsiRNA to retain significant MYC inhibitory efficacy in vitro. It was also notable that some of these DsiRNAs (e.g., MYC-1769 and MYC-1965) exhibited no apparent decline in MYC inhibitory efficacy in even the most highly modified states examined. Thus, such active modified DsiRNA sequences possess modification patterns believed to be capable of stabilizing such DsiRNAs and/or reducing immunogenicity of such DsiRNAs when therapeutically administered to a subject in vivo.

In certain embodiments, double stranded nucleic acids were selected that target the following sequences in MYC mRNA:

TABLE 11

MYC mRNA Target Sequences of Select dsRNAs

| Human MYC Duplex Name | Target mRNA Sequence | SEQ ID NO: |
|---|---|---|
| MYC-607 | ACGUUAGCUUCACCAACAGGAACUAUG | 1977 |
| MYC-622 | ACAGGAACUAUGACCUCGACUACGACU | 2125 |
| MYC-953 | GGACGACGAGACCUUCAUCAAAAACAU | 2155 |
| MYC-1360 | AACAAGAAGAUGAGGAAGAAAUCGAUG | 2222 |
| MYC-1364 | AGAAGAUGAGGAAGAAAUCGAUGUUGU | 1996 |
| MYC-1370 | UGAGGAAGAAAUCGAUGUUGUUUCUGU | 1997 |
| MYC-1698 | AACGAGCUAAAACGGAGCUUUUUUGCC | 2022 |
| MYC-1711 | GGAGCUUUUUUGCCCUGCGUGACCAGA | 2241 |
| MYC-1712 | GAGCUUUUUUGCCCUGCGUGACCAGAU | 2242 |
| MYC-1769 | CAAGGUAGUUAUCCUUAAAAAAGCCAC | 2028 |
| MYC-1926 | AGGAAAACGAUUCCUUCUAACAGAAAU | 2051 |
| MYC-1931 | AACGAUUCCUUCUAACAGAAAUGUCCU | 2052 |
| MYC-1944 | AACAGAAAUGUCCUGAGCAAUCACCUA | 2054 |
| MYC-1965 | CACCUAUGAACUUGUUUCAAAUGCAUG | 2057 |
| MYC-1981 | UCAAAUGCAUGAUCAAAUGCAACCUCA | 2060 |
| MYC-2040 | UAGCCAUAAUGUAAACUGCCUCAAAUU | 2069 |
| MYC-2066 | UGGACUUUGGGCAUAAAAGAACUUUUU | 2073 |
| MYC-2099 | UACCAUCUUUUUUUUUCUUUAACAGA | 2079 |
| MYC-2114 | UUCUUUAACAGAUUUGUAUUUAAGAAU | 2081 |
| MYC-2115 | UCUUUAACAGAUUUGUAUUUAAGAAUU | 2254 |
| MYC-2120 | AACAGAUUUGUAUUUAAGAAUUGUUUU | 2082 |
| MYC-2176 | CUCUGUAAAUAUUGCCAUUAAAUGUAA | 2086 |
| MYC-2196 | AAUGUAAAUAACUUUAAUAAAACGUUU | 2259 |
| MYC-2233 | CACAGAAUUUCAAUCCUAGUAUAUAGU | 2090 |
| MYC-607 | ACGUUAGCUUCACCAACAGGA | 1323 |
| MYC-622 | ACAGGAACUAUGACCUCGACU | 1471 |
| MYC-953 | GGACGACGAGACCUUCAUCAA | 1501 |
| MYC-1360 | AACAAGAAGAUGAGGAAGAAA | 1568 |
| MYC-1364 | AGAAGAUGAGGAAGAAAUCGA | 1342 |
| MYC-1370 | UGAGGAAGAAAUCGAUGUUGU | 1343 |
| MYC-1698 | AACGAGCUAAAACGGAGCUUU | 1368 |
| MYC-1711 | GGAGCUUUUUUGCCCUGCGUG | 1587 |
| MYC-1712 | GAGCUUUUUUGCCCUGCGUGA | 1588 |
| MYC-1769 | CAAGGUAGUUAUCCUUAAAAA | 1374 |
| MYC-1926 | AGGAAAACGAUUCCUUCUAAC | 1397 |
| MYC-1931 | AACGAUUCCUUCUAACAGAAA | 1398 |
| MYC-1944 | AACAGAAAUGUCCUGAGCAAU | 1400 |
| MYC-1965 | CACCUAUGAACUUGUUUCAAA | 1403 |

TABLE 11-continued

MYC mRNA Target Sequences of Select dsRNAs

| Human MYC Duplex Name | Target mRNA Sequence | SEQ ID NO: |
|---|---|---|
| MYC-1981 | UCAAAUGCAUGAUCAAAUGCA | 1406 |
| MYC-2040 | UAGCCAUAAUGUAAACUGCCU | 1415 |
| MYC-2066 | UGGACUUUGGGCAUAAAAGAA | 1419 |
| MYC-2099 | UACCAUCUUUUUUUUUCUUU | 1425 |
| MYC-2114 | UUCUUUAACAGAUUUGUAUUU | 1427 |
| MYC-2115 | UCUUUAACAGAUUUGUAUUUA | 1600 |
| MYC-2120 | AACAGAUUUGUAUUUAAGAAU | 1428 |
| MYC-2176 | CUCUGUAAAUAUUGCCAUUAA | 1432 |
| MYC-2196 | AAUGUAAAUAACUUUAAUAAA | 1605 |
| MYC-2233 | CACAGAAUUUCAAUCCUAGUA | 1436 |
| MYC-607 | ACGUUAGCUUCACCAACAG | 2958 |
| MYC-607 | CGUUAGCUUCACCAACAGG | 2631 |
| MYC-607 | GUUAGCUUCACCAACAGGA | 2304 |
| MYC-622 | ACAGGAACUAUGACCUCGA | 3106 |
| MYC-622 | CAGGAACUAUGACCUCGAC | 2779 |
| MYC-622 | AGGAACUAUGACCUCGACU | 2452 |
| MYC-953 | GGACGACGAGACCUUCAUC | 3136 |
| MYC-953 | GACGACGAGACCUUCAUCA | 2809 |
| MYC-953 | ACGACGAGACCUUCAUCAA | 2482 |
| MYC-1360 | AACAAGAAGAUGAGGAAGA | 3203 |
| MYC-1360 | ACAAGAAGAUGAGGAAGAA | 2876 |
| MYC-1360 | CAAGAAGAUGAGGAAGAAA | 2549 |
| MYC-1364 | AGAAGAUGAGGAAGAAAUC | 2977 |
| MYC-1364 | GAAGAUGAGGAAGAAAUCG | 2650 |
| MYC-1364 | AAGAUGAGGAAGAAAUCGA | 2323 |
| MYC-1370 | UGAGGAAGAAAUCGAUGUU | 2978 |
| MYC-1370 | GAGGAAGAAAUCGAUGUUG | 2651 |
| MYC-1370 | AGGAAGAAAUCGAUGUUGU | 2324 |
| MYC-1698 | AACGAGCUAAAACGGAGCU | 3003 |
| MYC-1698 | ACGAGCUAAAACGGAGCUU | 2676 |
| MYC-1698 | CGAGCUAAAACGGAGCUUU | 2349 |
| MYC-1711 | GGAGCUUUUUUGCCCUGCG | 3222 |
| MYC-1711 | GAGCUUUUUUGCCCUGCGU | 2895 |
| MYC-1711 | AGCUUUUUUGCCCUGCGUG | 2568 |
| MYC-1712 | GAGCUUUUUUGCCCUGCGU | 3223 |
| MYC-1712 | AGCUUUUUUGCCCUGCGUG | 2896 |
| MYC-1712 | GCUUUUUUGCCCUGCGUGA | 2569 |

TABLE 11-continued

MYC mRNA Target Sequences of Select dsRNAs

| Human MYC Duplex Name | Target mRNA Sequence | SEQ ID NO: |
|---|---|---|
| MYC-1769 | CAAGGUAGUUAUCCUUAAA | 3009 |
| MYC-1769 | AAGGUAGUUAUCCUUAAAA | 2682 |
| MYC-1769 | AGGUAGUUAUCCUUAAAAA | 2355 |
| MYC-1926 | AGGAAAACGAUUCCUUCUA | 3032 |
| MYC-1926 | GGAAAACGAUUCCUUCUAA | 2705 |
| MYC-1926 | GAAAACGAUUCCUUCUAAC | 2378 |
| MYC-1931 | AACGAUUCCUUCUAACAGA | 3033 |
| MYC-1931 | ACGAUUCCUUCUAACAGAA | 2706 |
| MYC-1931 | CGAUUCCUUCUAACAGAAA | 2379 |
| MYC-1944 | AACAGAAAUGUCCUGAGCA | 3035 |
| MYC-1944 | ACAGAAAUGUCCUGAGCAA | 2708 |
| MYC-1944 | CAGAAAUGUCCUGAGCAAU | 2381 |
| MYC-1965 | CACCUAUGAACUUGUUUCA | 3038 |
| MYC-1965 | ACCUAUGAACUUGUUUCAA | 2711 |
| MYC-1965 | CCUAUGAACUUGUUUCAAA | 2384 |
| MYC-1981 | UCAAAUGCAUGAUCAAAUG | 3041 |
| MYC-1981 | CAAAUGCAUGAUCAAAUGC | 2714 |
| MYC-1981 | AAAUGCAUGAUCAAAUGCA | 2387 |
| MYC-2040 | UAGCCAUAAUGUAAACUGC | 3050 |
| MYC-2040 | AGCCAUAAUGUAAACUGCC | 2723 |
| MYC-2040 | GCCAUAAUGUAAACUGCCU | 2396 |
| MYC-2066 | UGGACUUUGGGCAUAAAAG | 3054 |
| MYC-2066 | GGACUUUGGGCAUAAAAGA | 2727 |
| MYC-2066 | GACUUUGGGCAUAAAAGAA | 2400 |
| MYC-2099 | UACCAUCUUUUUUUUUCU | 3060 |
| MYC-2099 | ACCAUCUUUUUUUUUCUU | 2733 |
| MYC-2099 | CCAUCUUUUUUUUUCUUU | 2406 |
| MYC-2114 | UUCUUUAACAGAUUUGUAU | 3062 |
| MYC-2114 | UCUUUAACAGAUUUGUAUU | 2735 |
| MYC-2114 | CUUUAACAGAUUUGUAUUU | 2408 |
| MYC-2115 | UCUUUAACAGAUUUGUAUUU | 3235 |
| MYC-2115 | CUUUAACAGAUUUGUAUUU | 2908 |
| MYC-2115 | UUUAACAGAUUUGUAUUUA | 2581 |
| MYC-2120 | AACAGAUUUGUAUUUAAGA | 3063 |
| MYC-2120 | ACAGAUUUGUAUUUAAGAA | 2736 |
| MYC-2120 | CAGAUUUGUAUUUAAGAAU | 2409 |
| MYC-2176 | CUCUGUAAAUAUUGCCAUU | 3067 |
| MYC-2176 | UCUGUAAAUAUUGCCAUUA | 2740 |

TABLE 11-continued

MYC mRNA Target Sequences of Select dsRNAs

| Human MYC Duplex Name | Target mRNA Sequence | SEQ ID NO: |
|---|---|---|
| MYC-2176 | CUGUAAAUAUUGCCAUUAA | 2413 |
| MYC-2196 | AAUGUAAAUAACUUUAAUA | 3240 |
| MYC-2196 | AUGUAAAUAACUUUAAUAA | 2913 |
| MYC-2196 | UGUAAAUAACUUUAAUAAA | 2586 |
| MYC-2233 | CACAGAAUUUCAAUCCUAG | 3071 |
| MYC-2233 | ACAGAAUUUCAAUCCUAGU | 2744 |
| MYC-2233 | CAGAAUUUCAAUCCUAGUA | 2417 |

Additional select MYC mRNA target sequences include:

TABLE 12

Additional Select MYC mRNA Target Sequences of dsRNAs

| Human MYC Duplex Name | Target mRNA Sequence | SEQ ID NO: |
|---|---|---|
| MYC-607 | ACGUUAGCUUCACCAACAGGAACUAUG | 1977 |
| MYC-622 | ACAGGAACUAUGACCUCGACUACGACU | 2125 |
| MYC-953 | GGACGACGAGACCUUCAUCAAAAACAU | 2155 |
| MYC-1360 | AACAAGAAGAUGAGGAAGAAAUCGAUG | 2222 |
| MYC-1364 | AGAAGAUGAGGAAGAAAUCGAUGUUGU | 1996 |
| MYC-1370 | UGAGGAAGAAAUCGAUGUUGUUUCUGU | 1997 |
| MYC-1698 | AACGAGCUAAAACGGAGCUUUUUUGCC | 2022 |
| MYC-1711 | GGAGCUUUUUUGCCCUGCGUGACCAGA | 2241 |
| MYC-1712 | GAGCUUUUUUGCCCUGCGUGACCAGAU | 2242 |
| MYC-1769 | CAAGGUAGUUAUCCUUAAAAAAGCCAC | 2028 |
| MYC-1926 | AGGAAAACGAUUCCUUCUAACAGAAAU | 2051 |
| MYC-1931 | AACGAUUCCUUCUAACAGAAAUGUCCU | 2052 |
| MYC-1944 | AACAGAAAUGUCCUGAGCAAUCACCUA | 2054 |
| MYC-1965 | CACCUAUGAACUUGUUUCAAAUGCAUG | 2057 |
| MYC-1981 | UCAAAUGCAUGAUCAAAUGCAACCUCA | 2060 |
| MYC-2040 | UAGCCAUAAUGUAAACUGCCUCAAAUU | 2069 |
| MYC-2066 | UGGACUUUGGGCAUAAAAGAACUUUUU | 2073 |
| MYC-2099 | UACCAUCUUUUUUUUUUCUUUAACAGA | 2079 |
| MYC-2114 | UUCUUUAACAGAUUUGUAUUUAAGAAU | 2081 |
| MYC-2115 | UCUUUAACAGAUUUGUAUUUAAGAAUU | 2254 |
| MYC-2120 | AACAGAUUUGUAUUUAAGAAUUGUUUU | 2082 |
| MYC-2176 | CUCUGUAAAUAUUGCCAUUAAAUGUAA | 2086 |
| MYC-2196 | AAUGUAAAUAACUUUAAUAAAACGUUU | 2259 |
| MYC-2233 | CACAGAAUUUCAAUCCUAGUAUAUAGU | 2090 |

TABLE 12-continued

Additional Select MYC mRNA Target Sequences of dsRNAs

| Human MYC Duplex Name | Target mRNA Sequence | SEQ ID NO: |
|---|---|---|
| MYC-1360 | AACAAGAAGAUGAGGAAGAAA | 1568 |
| MYC-1364 | AGAAGAUGAGGAAGAAAUCGA | 1342 |
| MYC-1370 | UGAGGAAGAAAUCGAUGUUGU | 1343 |
| MYC-1698 | AACGAGCUAAAACGGAGCUUU | 1368 |
| MYC-1769 | CAAGGUAGUUAUCCUUAAAAA | 1374 |
| MYC-1931 | AACGAUUCCUUCUAACAGAAA | 1398 |
| MYC-1944 | AACAGAAAUGUCCUGAGCAAU | 1400 |
| MYC-1965 | CACCUAUGAACUUGUUUCAAA | 1403 |
| MYC-1981 | UCAAAUGCAUGAUCAAAUGCA | 1406 |
| MYC-2040 | UAGCCAUAAUGUAAACUGCCU | 1415 |
| MYC-2066 | UGGACUUUGGGCAUAAAAGAA | 1419 |
| MYC-2099 | UACCAUCUUUUUUUUUCUUU | 1425 |
| MYC-2114 | UUCUUUAACAGAUUUGUAUUU | 1427 |
| MYC-2115 | UCUUUAACAGAUUUGUAUUUA | 1600 |
| MYC-2176 | CUCUGUAAAUAUUGCCAUUAA | 1432 |
| MYC-2196 | AAUGUAAAUAACUUUAAUAAA | 1605 |
| MYC-2233 | CACAGAAUUUCAAUCCUAGUA | 1436 |
| MYC-1360 | AACAAGAAGAUGAGGAAGA | 3203 |
| MYC-1360 | ACAAGAAGAUGAGGAAGAA | 2876 |
| MYC-1360 | CAAGAAGAUGAGGAAGAAA | 2549 |
| MYC-1364 | AGAAGAUGAGGAAGAAAUC | 2977 |
| MYC-1364 | GAAGAUGAGGAAGAAAUCG | 2650 |
| MYC-1364 | AAGAUGAGGAAGAAAUCGA | 2323 |
| MYC-1370 | UGAGGAAGAAAUCGAUGUU | 2978 |
| MYC-1370 | GAGGAAGAAAUCGAUGUUG | 2651 |
| MYC-1370 | AGGAAGAAAUCGAUGUUGU | 2324 |
| MYC-1698 | AACGAGCUAAAACGGAGCU | 3003 |
| MYC-1698 | ACGAGCUAAAACGGAGCUU | 2676 |
| MYC-1698 | CGAGCUAAAACGGAGCUUU | 2349 |
| MYC-1769 | CAAGGUAGUUAUCCUUAAA | 3009 |
| MYC-1769 | AAGGUAGUUAUCCUUAAAA | 2682 |
| MYC-1769 | AGGUAGUUAUCCUUAAAAA | 2355 |
| MYC-1931 | AACGAUUCCUUCUAACAGA | 3033 |
| MYC-1931 | ACGAUUCCUUCUAACAGAA | 2706 |
| MYC-1931 | CGAUUCCUUCUAACAGAAA | 2379 |
| MYC-1944 | AACAGAAAUGUCCUGAGCA | 3035 |
| MYC-1944 | ACAGAAAUGUCCUGAGCAA | 2708 |

TABLE 12-continued

Additional Select MYC mRNA Target Sequences of dsRNAs

| Human MYC Duplex Name | Target mRNA Sequence | SEQ ID NO: |
|---|---|---|
| MYC-1944 | CAGAAAUGUCCUGAGCAAU | 2381 |
| MYC-1965 | CACCUAUGAACUUGUUUCA | 3038 |
| MYC-1965 | ACCUAUGAACUUGUUUCAA | 2711 |
| MYC-1965 | CCUAUGAACUUGUUUCAAA | 2384 |
| MYC-1981 | UCAAAUGCAUGAUCAAAUG | 3041 |
| MYC-1981 | CAAAUGCAUGAUCAAAUGC | 2714 |
| MYC-1981 | AAAUGCAUGAUCAAAUGCA | 2387 |
| MYC-2040 | UAGCCAUAAUGUAAACUGC | 3050 |
| MYC-2040 | AGCCAUAAUGUAAACUGCC | 2723 |
| MYC-2040 | GCCAUAAUGUAAACUGCCU | 2396 |
| MYC-2066 | UGGACUUUGGGCAUAAAAG | 3054 |
| MYC-2066 | GGACUUUGGGCAUAAAAGA | 2727 |
| MYC-2066 | GACUUUGGGCAUAAAAGAA | 2400 |
| MYC-2099 | UACCAUCUUUUUUUUUUCU | 3060 |
| MYC-2099 | ACCAUCUUUUUUUUUCUU | 2733 |
| MYC-2099 | CCAUCUUUUUUUUUCUUU | 2406 |
| MYC-2114 | UUCUUUAACAGAUUUGUAU | 3062 |
| MYC-2114 | UCUUUAACAGAUUUGUAUU | 2735 |
| MYC-2114 | CUUUAACAGAUUUGUAUUU | 2408 |
| MYC-2115 | UCUUUAACAGAUUUGUAUU | 3235 |
| MYC-2115 | CUUUAACAGAUUUGUAUUU | 2908 |
| MYC-2115 | UUUAACAGAUUUGUAUUUA | 2581 |
| MYC-2176 | CUCUGUAAAUAUUGCCAUU | 3067 |
| MYC-2176 | UCUGUAAAUAUUGCCAUUA | 2740 |
| MYC-2176 | CUGUAAAUAUUGCCAUUAA | 2413 |
| MYC-2196 | AAUGUAAAUAACUUUAAUA | 3240 |
| MYC-2196 | AUGUAAAUAACUUUAAUAA | 2913 |
| MYC-2196 | UGUAAAUAACUUUAAUAAA | 2586 |
| MYC-2233 | CACAGAAUUUCAAUCCUAG | 3071 |
| MYC-2233 | ACAGAAUUUCAAUCCUAGU | 2744 |
| MYC-2233 | CAGAAUUUCAAUCCUAGUA | 2417 |

Further select MYC mRNA target sequences include:

TABLE 13

Further Select MYC mRNA Target Sequences of dsRNAs

| Human MYC Duplex Name | Target mRNA Sequence | SEQ ID NO: |
|---|---|---|
| MYC-607 | ACGUUAGCUUCACCAACAGGAACUAUG | 1977 |
| MYC-953 | GGACGACGAGACCUUCAUCAAAAACAU | 2155 |
| MYC-1364 | AGAAGAUGAGGAAGAAAUCGAUGUUGU | 1996 |
| MYC-1370 | UGAGGAAGAAAUCGAUGUUGUUUCUGU | 1997 |
| MYC-1698 | AACGAGCUAAAACGGAGCUUUUUUGCC | 2022 |
| MYC-1711 | GGAGCUUUUUUGCCCUGCGUGACCAGA | 2241 |
| MYC-1712 | GAGCUUUUUUGCCCUGCGUGACCAGAU | 2242 |
| MYC-1769 | CAAGGUAGUUAUCCUUAAAAAAGCCAC | 2028 |
| MYC-1926 | AGGAAAACGAUUCCUUCUAACAGAAAU | 2051 |
| MYC-1931 | AACGAUUCCUUCUAACAGAAAUGUCCU | 2052 |
| MYC-1944 | AACAGAAAUGUCCUGAGCAAUCACCUA | 2054 |
| MYC-1981 | UCAAAUGCAUGAUCAAAUGCAACCUCA | 2060 |
| MYC-2040 | UAGCCAUAAUGUAAACUGCCUCAAAUU | 2069 |
| MYC-2066 | UGGACUUUGGGCAUAAAAGAACUUUUU | 2073 |
| MYC-2099 | UACCAUCUUUUUUUUUCUUUAACAGA | 2079 |
| MYC-2114 | UUCUUUAACAGAUUUGUAUUUAAGAAU | 2081 |
| MYC-2115 | UCUUUAACAGAUUUGUAUUUAAGAAUU | 2254 |
| MYC-2120 | AACAGAUUUGUAUUUAAGAAUUGUUUU | 2082 |
| MYC-2176 | CUCUGUAAAUAUUGCCAUUAAAUGUAA | 2086 |
| MYC-2196 | AAUGUAAAUAACUUUAAUAAAACGUUU | 2259 |
| MYC-2233 | CACAGAAUUUCAAUCCUAGUAUAUAGU | 2090 |
| MYC-607 | ACGUUAGCUUCACCAACAGGA | 1323 |
| MYC-953 | GGACGACGAGACCUUCAUCAA | 1501 |
| MYC-1364 | AGAAGAUGAGGAAGAAAUCGA | 1342 |
| MYC-1370 | UGAGGAAGAAAUCGAUGUUGU | 1343 |
| MYC-1698 | AACGAGCUAAAACGGAGCUUU | 1368 |
| MYC-1711 | GGAGCUUUUUUGCCCUGCGUG | 1587 |
| MYC-1712 | GAGCUUUUUUGCCCUGCGUGA | 1588 |
| MYC-1769 | CAAGGUAGUUAUCCUUAAAAA | 1374 |
| MYC-1926 | AGGAAAACGAUUCCUUCUAAC | 1397 |
| MYC-1931 | AACGAUUCCUUCUAACAGAAA | 1398 |
| MYC-1944 | AACAGAAAUGUCCUGAGCAAU | 1400 |
| MYC-1981 | UCAAAUGCAUGAUCAAAUGCA | 1406 |
| MYC-2040 | UAGCCAUAAUGUAAACUGCCU | 1415 |
| MYC-2066 | UGGACUUUGGGCAUAAAAGAA | 1419 |
| MYC-2099 | UACCAUCUUUUUUUUUCUUU | 1425 |

TABLE 13-continued

Further Select MYC mRNA Target Sequences of dsRNAs

| Human MYC Duplex Name | Target mRNA Sequence | SEQ ID NO: |
|---|---|---|
| MYC-2114 | UUCUUUAACAGAUUUGUAUUU | 1427 |
| MYC-2115 | UCUUUAACAGAUUUGUAUUUA | 1600 |
| MYC-2120 | AACAGAUUUGUAUUUAAGAAU | 1428 |
| MYC-2176 | CUCUGUAAAUAUUGCCAUUAA | 1432 |
| MYC-2196 | AAUGUAAAUAACUUUAAUAAA | 1605 |
| MYC-2233 | CACAGAAUUUCAAUCCUAGUA | 1436 |
| MYC-607 | ACGUUAGCUUCACCAACAG | 2958 |
| MYC-607 | CGUUAGCUUCACCAACAGG | 2631 |
| MYC-607 | GUUAGCUUCACCAACAGGA | 2304 |
| MYC-953 | GGACGACGAGACCUUCAUC | 3136 |
| MYC-953 | GACGACGAGACCUUCAUCA | 2809 |
| MYC-953 | ACGACGAGACCUUCAUCAA | 2482 |
| MYC-1364 | AGAAGAUGAGGAAGAAAUC | 2977 |
| MYC-1364 | GAAGAUGAGGAAGAAAUCG | 2650 |
| MYC-1364 | AAGAUGAGGAAGAAAUCGA | 2323 |
| MYC-1370 | UGAGGAAGAAAUCGAUGUU | 2978 |
| MYC-1370 | GAGGAAGAAAUCGAUGUUG | 2651 |
| MYC-1370 | AGGAAGAAAUCGAUGUUGU | 2324 |
| MYC-1698 | AACGAGCUAAAACGGAGCU | 3003 |
| MYC-1698 | ACGAGCUAAAACGGAGCUU | 2676 |
| MYC-1698 | CGAGCUAAAACGGAGCUUU | 2349 |
| MYC-1711 | GGAGCUUUUUGCCCUGCG | 3222 |
| MYC-1711 | GAGCUUUUUGCCCUGCGU | 2895 |
| MYC-1711 | AGCUUUUUGCCCUGCGUG | 2568 |
| MYC-1712 | GAGCUUUUUGCCCUGCGU | 3223 |
| MYC-1712 | AGCUUUUUGCCCUGCGUG | 2896 |
| MYC-1712 | GCUUUUUGCCCUGCGUGA | 2569 |
| MYC-1769 | CAAGGUAGUUAUCCUUAAA | 3009 |
| MYC-1769 | AAGGUAGUUAUCCUUAAAA | 2682 |
| MYC-1769 | AGGUAGUUAUCCUUAAAAA | 2355 |
| MYC-1926 | AGGAAAACGAUUCCUUCUA | 3032 |
| MYC-1926 | GGAAAACGAUUCCUUCUAA | 2705 |
| MYC-1926 | GAAAACGAUUCCUUCUAAC | 2378 |
| MYC-1931 | AACGAUUCCUUCUAACAGA | 3033 |
| MYC-1931 | ACGAUUCCUUCUAACAGAA | 2706 |
| MYC-1931 | CGAUUCCUUCUAACAGAAA | 2379 |
| MYC-1944 | AACAGAAAUGUCCUGAGCA | 3035 |
| MYC-1944 | ACAGAAAUGUCCUGAGCAA | 2708 |
| MYC-1944 | CAGAAAUGUCCUGAGCAAU | 2381 |
| MYC-1981 | UCAAAUGCAUGAUCAAAUG | 3041 |
| MYC-1981 | CAAAUGCAUGAUCAAAUGC | 2714 |
| MYC-1981 | AAAUGCAUGAUCAAAUGCA | 2387 |
| MYC-2040 | UAGCCAUAAUGUAAACUGC | 3050 |
| MYC-2040 | AGCCAUAAUGUAAACUGCC | 2723 |
| MYC-2040 | GCCAUAAUGUAAACUGCCU | 2396 |
| MYC-2066 | UGGACUUUGGGCAUAAAAG | 3054 |
| MYC-2066 | GGACUUUGGGCAUAAAAGA | 2727 |
| MYC-2066 | GACUUUGGGCAUAAAAGAA | 2400 |
| MYC-2099 | UACCAUCUUUUUUUUUUCU | 3060 |
| MYC-2099 | ACCAUCUUUUUUUUUCUU | 2733 |
| MYC-2099 | CCAUCUUUUUUUUUCUUU | 2406 |
| MYC-2114 | UUCUUUAACAGAUUUGUAU | 3062 |
| MYC-2114 | UCUUUAACAGAUUUGUAUU | 2735 |
| MYC-2114 | CUUUAACAGAUUUGUAUUU | 2408 |
| MYC-2115 | UCUUUAACAGAUUUGUAUU | 3235 |
| MYC-2115 | CUUUAACAGAUUUGUAUUU | 2908 |
| MYC-2115 | UUUAACAGAUUUGUAUUUA | 2581 |
| MYC-2120 | AACAGAUUUGUAUUUAAGA | 3063 |
| MYC-2120 | ACAGAUUUGUAUUUAAGAA | 2736 |
| MYC-2120 | CAGAUUUGUAUUUAAGAAU | 2409 |
| MYC-2176 | CUCUGUAAAUAUUGCCAUU | 3067 |
| MYC-2176 | UCUGUAAAUAUUGCCAUUA | 2740 |
| MYC-2176 | CUGUAAAUAUUGCCAUUAA | 2413 |
| MYC-2196 | AAUGUAAAUAACUUUAAUA | 3240 |
| MYC-2196 | AUGUAAAUAACUUUAAUAA | 2913 |
| MYC-2196 | UGUAAAUAACUUUAAUAAA | 2586 |
| MYC-2233 | CACAGAAUUUCAAUCCUAG | 3071 |
| MYC-2233 | ACAGAAUUUCAAUCCUAGU | 2744 |
| MYC-2233 | CAGAAUUUCAAUCCUAGUA | 2417 |

Certain additional selections of MYC mRNA targets included the following:

TABLE 14

Selected MYC mRNA Target Sequences of dsRNAs

| Human MYC Duplex Name | Target mRNA Sequence | SEQ ID NO: |
|---|---|---|
| MYC-2099 | UACCAUCUUUUUUUUUCUUUAACAGA | 2079 |
| MYC-2176 | CUCUGUAAAUAUUGCCAUUAAAUGUAA | 2086 |
| MYC-2196 | AAUGUAAAUAACUUUAAUAAAACGUUU | 2259 |
| MYC-1698 | AACGAGCUAAAACGGAGCUUU | 1368 |
| MYC-1769 | CAAGGUAGUUAUCCUUAAAAA | 1374 |
| MYC-1931 | AACGAUUCCUUCUAACAGAAA | 1398 |
| MYC-1944 | AACAGAAAUGUCCUGAGCAAU | 1400 |
| MYC-1981 | UCAAAUGCAUGAUCAAAUGCA | 1406 |
| MYC-2099 | UACCAUCUUUUUUUUUCUUU | 1425 |
| MYC-2176 | CUCUGUAAAUAUUGCCAUUAA | 1432 |
| MYC-2196 | AAUGUAAAUAACUUUAAUAAA | 1605 |
| MYC-2233 | CACAGAAUUUCAAUCCUAGUA | 1436 |
| MYC-1698 | AACGAGCUAAAACGGAGCU | 3003 |
| MYC-1698 | ACGAGCUAAAACGGAGCUU | 2676 |
| MYC-1698 | CGAGCUAAAACGGAGCUUU | 2349 |
| MYC-1769 | CAAGGUAGUUAUCCUUAAA | 3009 |
| MYC-1769 | AAGGUAGUUAUCCUUAAAA | 2682 |
| MYC-1769 | AGGUAGUUAUCCUUAAAAA | 2355 |
| MYC-1931 | AACGAUUCCUUCUAACAGA | 3033 |
| MYC-1931 | ACGAUUCCUUCUAACAGAA | 2706 |
| MYC-1931 | CGAUUCCUUCUAACAGAAA | 2379 |
| MYC-1944 | AACAGAAAUGUCCUGAGCA | 3035 |
| MYC-1944 | ACAGAAAUGUCCUGAGCAA | 2708 |
| MYC-1944 | CAGAAAUGUCCUGAGCAAU | 2381 |
| MYC-1981 | UCAAAUGCAUGAUCAAAUG | 3041 |
| MYC-1981 | CAAAUGCAUGAUCAAAUGC | 2714 |
| MYC-1981 | AAAUGCAUGAUCAAAUGCA | 2387 |
| MYC-2066 | UGGACUUUGGGCAUAAAAG | 3054 |
| MYC-2066 | GGACUUUGGGCAUAAAAGA | 2727 |
| MYC-2099 | UACCAUCUUUUUUUUUCU | 3060 |
| MYC-2099 | ACCAUCUUUUUUUUUCUU | 2733 |
| MYC-2099 | CCAUCUUUUUUUUUCUUU | 2406 |
| MYC-2114 | UUCUUUAACAGAUUUGUAU | 3062 |
| MYC-2114 | UCUUUAACAGAUUUGUAUU | 2735 |
| MYC-2115 | UCUUUAACAGAUUUGUAUU | 3235 |
| MYC-2176 | CUCUGUAAAUAUUGCCAUU | 3067 |
| MYC-2176 | UCUGUAAAUAUUGCCAUUA | 2740 |
| MYC-2176 | CUGUAAAUAUUGCCAUUAA | 2413 |
| MYC-2196 | AAUGUAAAUAACUUUAAUA | 3240 |
| MYC-2196 | AUGUAAAUAACUUUAAUAA | 2913 |
| MYC-2196 | UGUAAAUAACUUUAAUAAA | 2586 |
| MYC-2233 | CACAGAAUUUCAAUCCUAG | 3071 |
| MYC-2233 | ACAGAAUUUCAAUCCUAGU | 2744 |
| MYC-2233 | CAGAAUUUCAAUCCUAGUA | 2417 |

Certain further selections of MYC mRNA targets included the following:

TABLE 15

Further Selected MYC mRNA Target Sequences of dsRNAs

| Human MYC Duplex Name | Target mRNA Sequence | SEQ ID NO: |
|---|---|---|
| MYC-2176 | CUCUGUAAAUAUUGCCAUUAAAUGUAA | 2086 |
| MYC-2099 | UACCAUCUUUUUUUUUCUUU | 1425 |
| MYC-2176 | CUCUGUAAAUAUUGCCAUUAA | 1432 |
| MYC-2196 | AAUGUAAAUAACUUUAAUAAA | 1605 |
| MYC-1769 | AGGUAGUUAUCCUUAAAAA | 2355 |
| MYC-2099 | UACCAUCUUUUUUUUUCU | 3060 |
| MYC-2099 | ACCAUCUUUUUUUUUCUU | 2733 |
| MYC-2099 | CCAUCUUUUUUUUUCUUU | 2406 |
| MYC-2176 | CUCUGUAAAUAUUGCCAUU | 3067 |
| MYC-2176 | UCUGUAAAUAUUGCCAUUA | 2740 |
| MYC-2176 | CUGUAAAUAUUGCCAUUAA | 2413 |
| MYC-2196 | AAUGUAAAUAACUUUAAUA | 3240 |
| MYC-2196 | AUGUAAAUAACUUUAAUAA | 2913 |
| MYC-2196 | UGUAAAUAACUUUAAUAAA | 2586 |

Example 6

Target mRNA Mismatch Tolerance of MYC-Targeting DsiRNAs

Whether seven different native MYC mRNA-targeting DsiRNAs (MYC-622, MYC-953, MYC-1364, MYC-1370, MYC-1711, MYC-1769 and MYC-1965) could incorporate mismatches with respect to their target mRNA sequence yet still retain robust inhibitory activity was examined. As shown in FIGS. 6A-6D, the following DsiRNA duplex sequences (possessing passenger strand-guide strand modification patterns as indicated) were tested for MYC knockdown activity (Bold indicates residues that form mismatches with respect to the target MYC transcript sequence):

MYC-622 (Native sequence):
(SEQ ID NO: 163)
5'-AGGAACUAUGACCUCGACUACGAct-3'
(SEQ ID NO: 490)
3'-UGUCCUUGAUACUGGAGCUGAUGCUGA-5'

MYC-622_m1:
(SEQ ID NO: 3879)
5'-AGGAACCAUGACCUCGACUACGAct-3'
(SEQ ID NO: 3880)
3'-UGUCCUUGGUACUGGAGCUGAUGCUGA-5'

MYC-622_m2:
(SEQ ID NO: 3881)
5'-AGAAACUAUGACCUCGACUACAAct-3'
(SEQ ID NO: 3882)
3'-UGUCUUUGAUACUGGAGCUGAUGUUGA-5'

MYC-622_m3:
(SEQ ID NO: 3883)
5'-AAGAACUAUGACCUCGACUAACGct-3'
(SEQ ID NO: 3884)
3'-UGUUCUUGAUACUGGAGCUGAUUGCGA-5'

MYC-953 (Native sequence):
(SEQ ID NO: 193)
5'-ACGACGAGACCUUCAUCAAAAACat-3'
(SEQ ID NO: 520)
3'-CCUGCUGCUCUGGAAGUAGUUUUUGUA-5'

MYC-953_m1:
(SEQ ID NO: 3885)
5'-ACAACGAGACCUUCAUCAAAAACat-3'
(SEQ ID NO: 3886)
3'-CCUGUUGCUCUGGAAGUAGUUUUUGUA-5'

MYC-953_m2:
(SEQ ID NO: 3887)
5'-ACGACAAGACCUUCAUCAAAAACat-3'
(SEQ ID NO: 3888)
3'-CCUGCUGUUCUGGAAGUAGUUUUUGUA-5'

MYC-953_m3:
(SEQ ID NO: 3889)
5'-ACGACGAGACCUUCAUCAAUAACat-3'
(SEQ ID NO: 3890)
3'-UCUGCUGCUCUGGAAGUAGUUAUUGUA-5'

MYC-1364 (Native sequence):
(SEQ ID NO: 34)
5'-AAGAUGAGGAAGAAAUCGAUGUUgt-3'
(SEQ ID NO: 361)
3'-UCUUCUACUCCUUCUUUAGCUACAACA-5'

MYC-1364_m1:
(SEQ ID NO: 3891)
5'-AAGAUGAAGAAGAAAUCGAUGUUgt-3'
(SEQ ID NO: 3892)
3'-UCUUCUACUUCUUCUUUAGCUACAACA-5'

MYC-1364_m2:
(SEQ ID NO: 3893)
5'-AAGAUGAGGAAGAAAUCGAAGUUgt-3'
(SEQ ID NO: 3894)
3'-UCUUCUACUCCUUCUUUAGCUUCAACA-5'

MYC-1364_m3:
(SEQ ID NO: 3895)
5'-AAGAUGAGGAAGAAAUCGAUGAUgt-3'
(SEQ ID NO: 3896)
3'-UCUUCUACUCCUUCUUUAGCUACUACA-5'

MYC-1364_m4:
(SEQ ID NO: 3897)
5'-AAGAUGAGGAAGAAAUCGAUAGUgt-3'
(SEQ ID NO: 3898)
3'-UCUUCUACUCCUUCUUUAGCUAUCACA-5'

MYC-1370 (Native sequence):
(SEQ ID NO: 35)
5'-AGGAAGAAAUCGAUGUUGUUUCgt-3'
(SEQ ID NO: 362)
3'-ACUCCUUCUUUAGCUACAACAAAGACA-5'

MYC-1370_m1:
(SEQ ID NO: 3899)
5'-AAGAAGAAAUCGAUGUUGUUACUgt-3'
(SEQ ID NO: 3900)
3'-ACUUCUUCUUUAGCUACAACAAUGACA-5'

MYC-1370_m2:
(SEQ ID NO: 3901)
5'-AGAAAGAAAUCGAUGUUGUUACUgt-3'
(SEQ ID NO: 3902)
3'-ACUCUUUCUUUAGCUACAACAAUGACA-5'

MYC-1370_m3:
(SEQ ID NO: 3903)
5'-AGGAAAAAAUCGAUGUUGUUACUgt-3'
(SEQ ID NO: 3904)
3'-ACUCCUUUUUUAGCUACAACAAUGACA-5'

MYC-1370_m4:
(SEQ ID NO: 3905)
5'-AGGAAAAAAUCGAUGUUGUUUCgt-3'
(SEQ ID NO: 3906)
3'-ACUCCUUUUUUAGCUACAACAAAAGCA-5'

MYC-1711 (Native sequence):
(SEQ ID NO: 279)
5'-AGCUUUUUUGCCCUGCGUGACCAga-3'
(SEQ ID NO: 606)
3'-CCUCGAAAAAACGGGACGCACUGGUCU-5'

MYC-1711_m1:
(SEQ ID NO: 3907)
5'-AGCUUUCUUGCCCUGCGUGACCAga-3'
(SEQ ID NO: 3908)
3'-CCUCGAAAGAACGGGACGCACUGGUCU-5'

MYC-1711_m3:
(SEQ ID NO: 3909)
5'-AGCUUCUUUGCCCUGCGUGAACCga-3'
(SEQ ID NO: 3910)
3'-CCUCGAAGAAACGGGACGCACUUGGCU-5'

MYC-1711_m4:
(SEQ ID NO: 3911)
5'-AGCUCUUUUGCCCUGCGUGUCCAga-3'
(SEQ ID NO: 3912)
3'-CCUCGAGAAAACGGGACGCACAGGUCU-5'

MYC-1769 (Native sequence):
(SEQ ID NO: 66)
5'-AGGUAGUUAUCCUUAAAAAAGCCac-3'
(SEQ ID NO: 393)
3'-GUUCCAUCAAUAGGAAUUUUUUCGGUG-5'

MYC-1769_m1:
(SEQ ID NO: 3913)
5'-AGGUAGUUAUCCUUAAAAAACCCac-3'
(SEQ ID NO: 3914)
3'-GUUCCAUCAAUAGGAAUUUUUUGGGUG-5'

MYC-1769_m2:
(SEQ ID NO: 3915)
5'-AGGUAGUUAUCCUUAAAAAAGGCac-3'
(SEQ ID NO: 3916)
3'-GUUCCAUCAAUAGGAAUUUUUUCCGUG-5'

MYC-1769_m4:
(SEQ ID NO: 3917)
5'-AGGUAGUUAUCCUUAAAAAAAGCcc-3'
(SEQ ID NO: 3918)
3'-GUUCCAUCAAUAGGAAUUUUUUUCGGG-5'

```
                          -continued
MYC-1769_m5:
                                       (SEQ ID NO: 3919)
5'-AGGCAGUUAUCCUUAAAAAAGCCac-3'
                                       (SEQ ID NO: 3920)
3'-GUUCCGUCAAUAGGAAUUUUUUCGGUG-5'

MYC-1965 (Native sequence):
                                       (SEQ ID NO: 95)
5'-CCUAUGAACUUGUUUCAAAUGCAtg-3'
                                       (SEQ ID NO: 422)
3'-GUGGAUACUUGAACAAAGUUUACGUAC-5'

MYC-1965_m1:
                                       (SEQ ID NO: 3921)
5'-CCUAUAAACUUGUUUCAAAUGCAtg-3'
                                       (SEQ ID NO: 3922)
3'-GUGGAUAUUUGAACAAAGUUUACGUAC-5'

MYC-1965_m2:
                                       (SEQ ID NO: 3923)
5'-CCUAUGAACUUGUUUCAAAUGCUtg-3'
                                       (SEQ ID NO: 3924)
3'-CUGGAUACUUGAACAAAGUUUACGAAC-5'

MYC-1965_m3:
                                       (SEQ ID NO: 3925)
5'-CCUAUGAACUUGUUUCAAAUGCAag-3'
                                       (SEQ ID NO: 3926)
3'-CUGGAUACUUGAACAAAGUUUACGUUC-5'

MYC-1965_m4:
                                       (SEQ ID NO: 3927)
5'-CCUAUGAACUUGUUUCAAAUAGCtg-3'
                                       (SEQ ID NO: 3928)
3'-CUGGAUACUUGAACAAAGUUUAUCGAC-5'
```

As shown in FIGS. 6A-6D, most of the above duplexes possessing mismatches with respect to target MYC transcript sequences retained MYC knockdown activity. For many, the potency of such knockdown was similar to that observed for native duplex sequences.

Example 7

Further Modification Pattern Assessment of MYC-Targeting DsiRNAs In Vitro

Figure 7A:
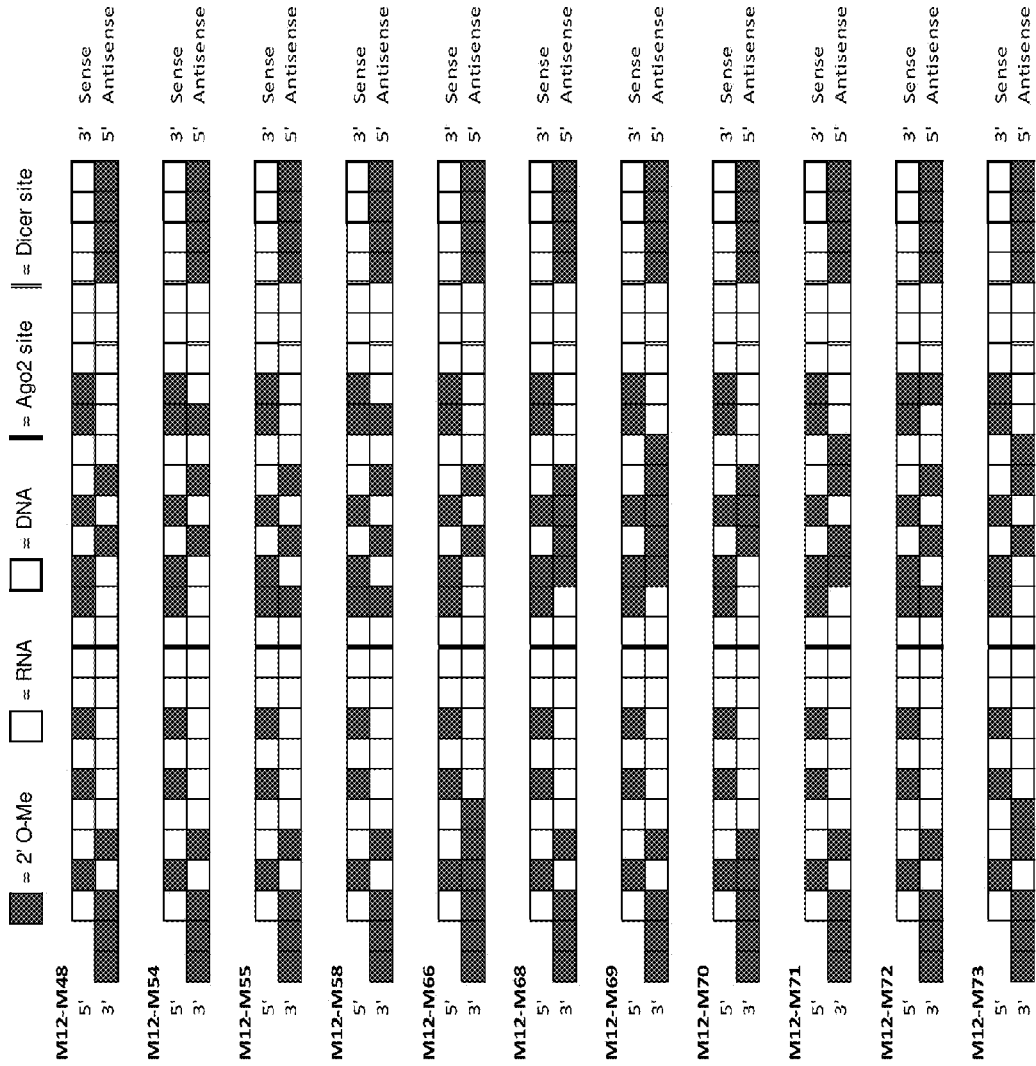
Figure 7B:
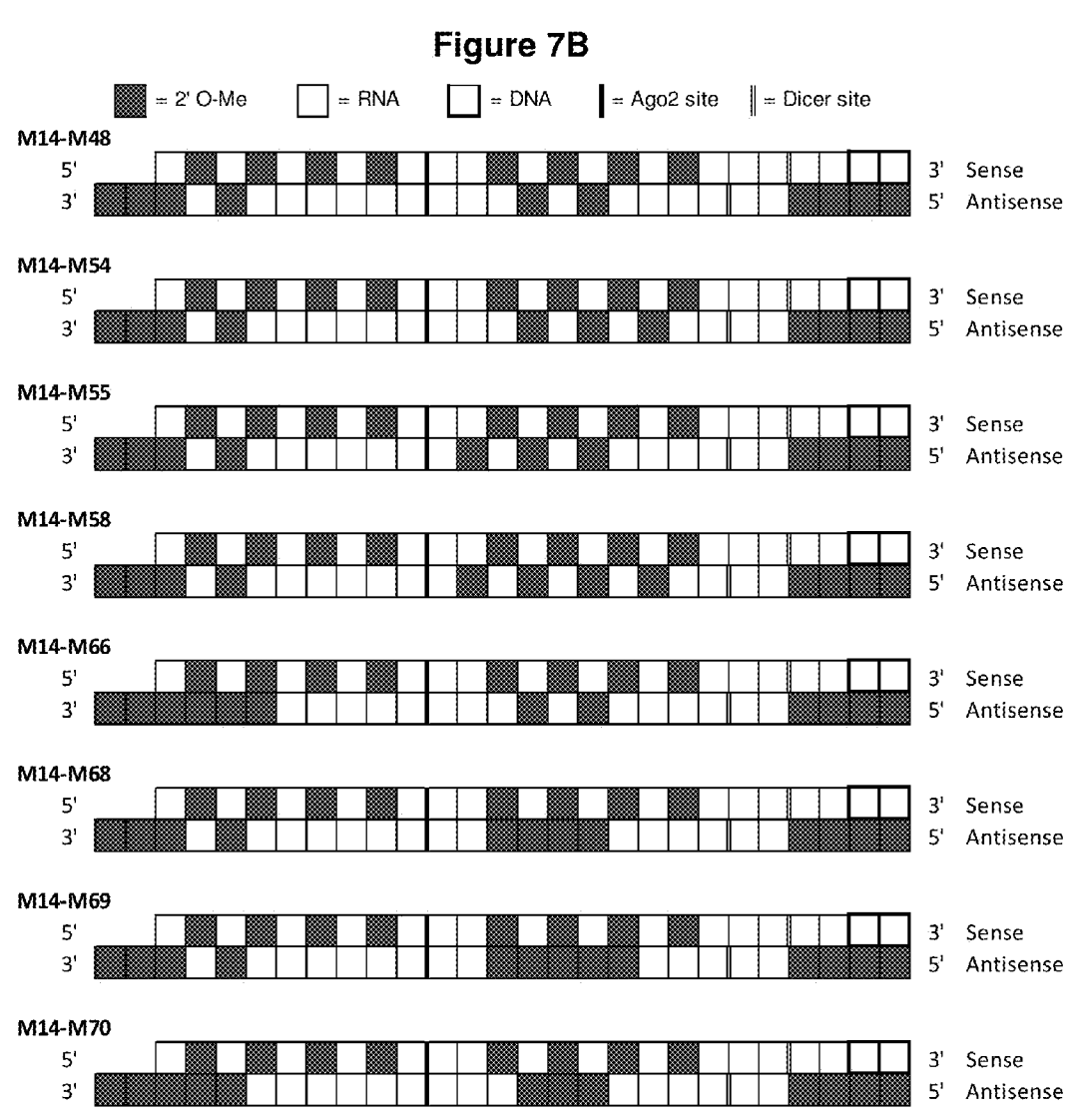
Figure 7C:
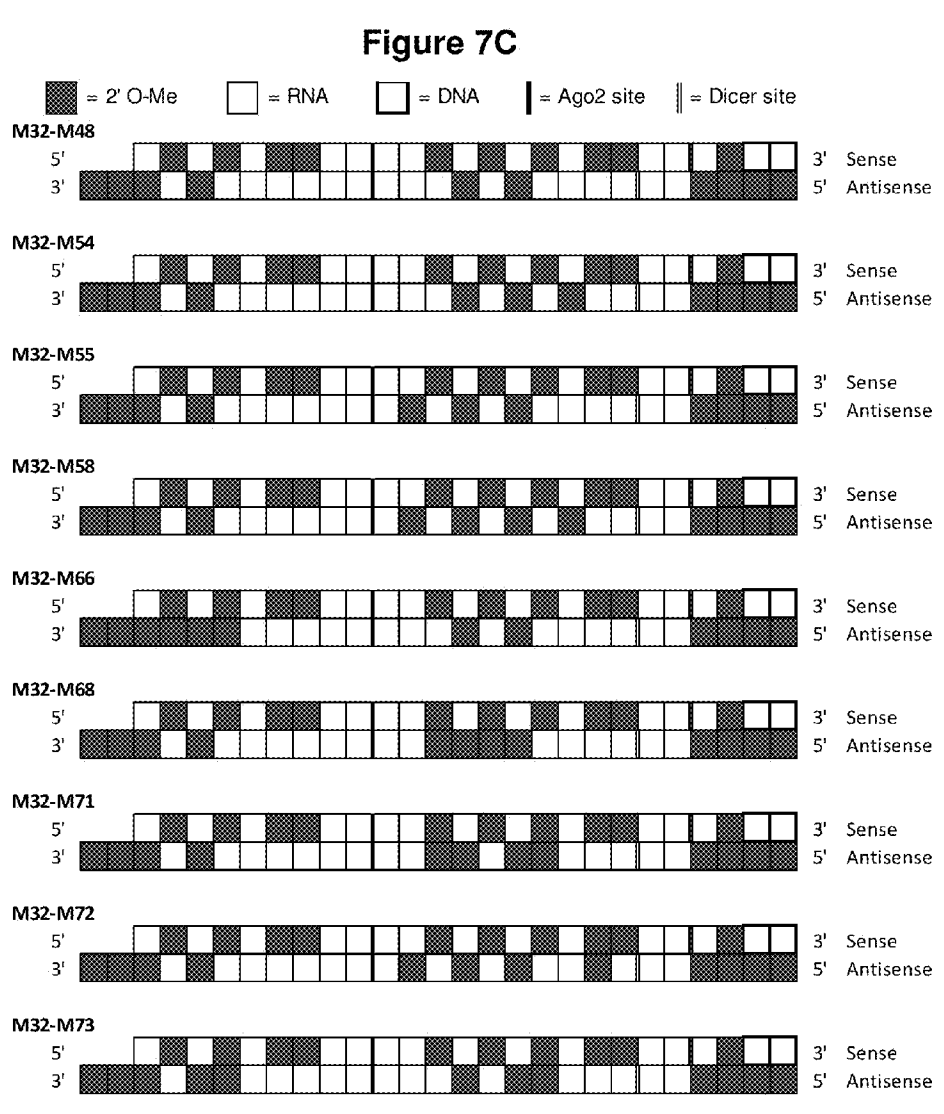
Figure 7D:
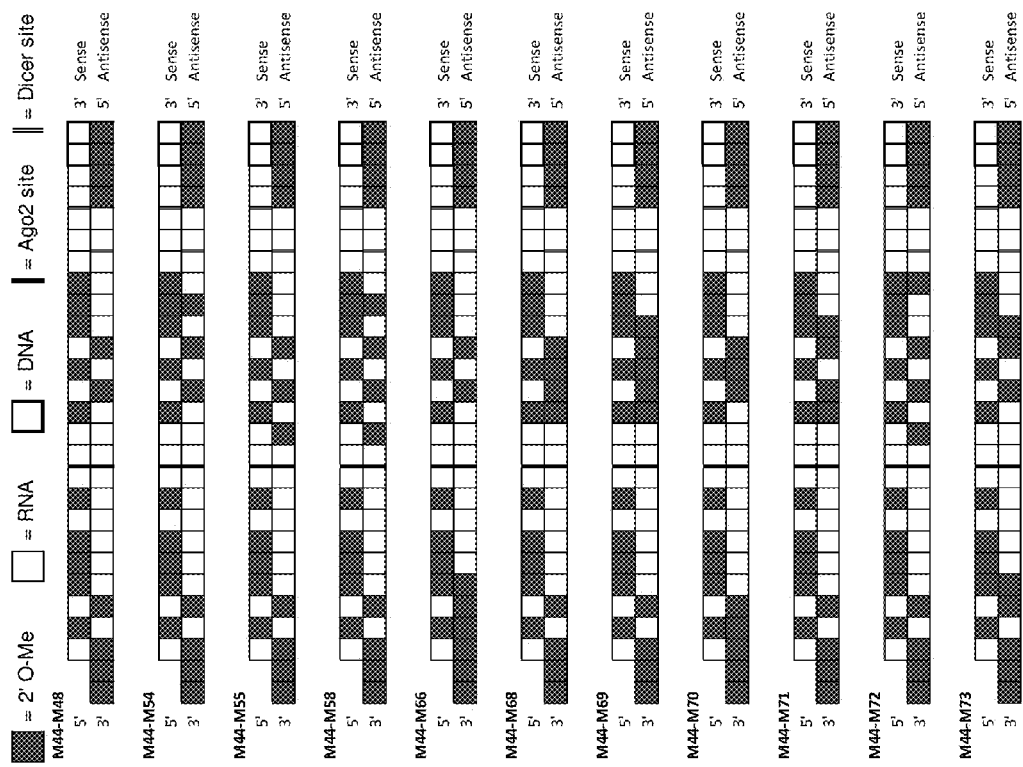
Figure 7E:
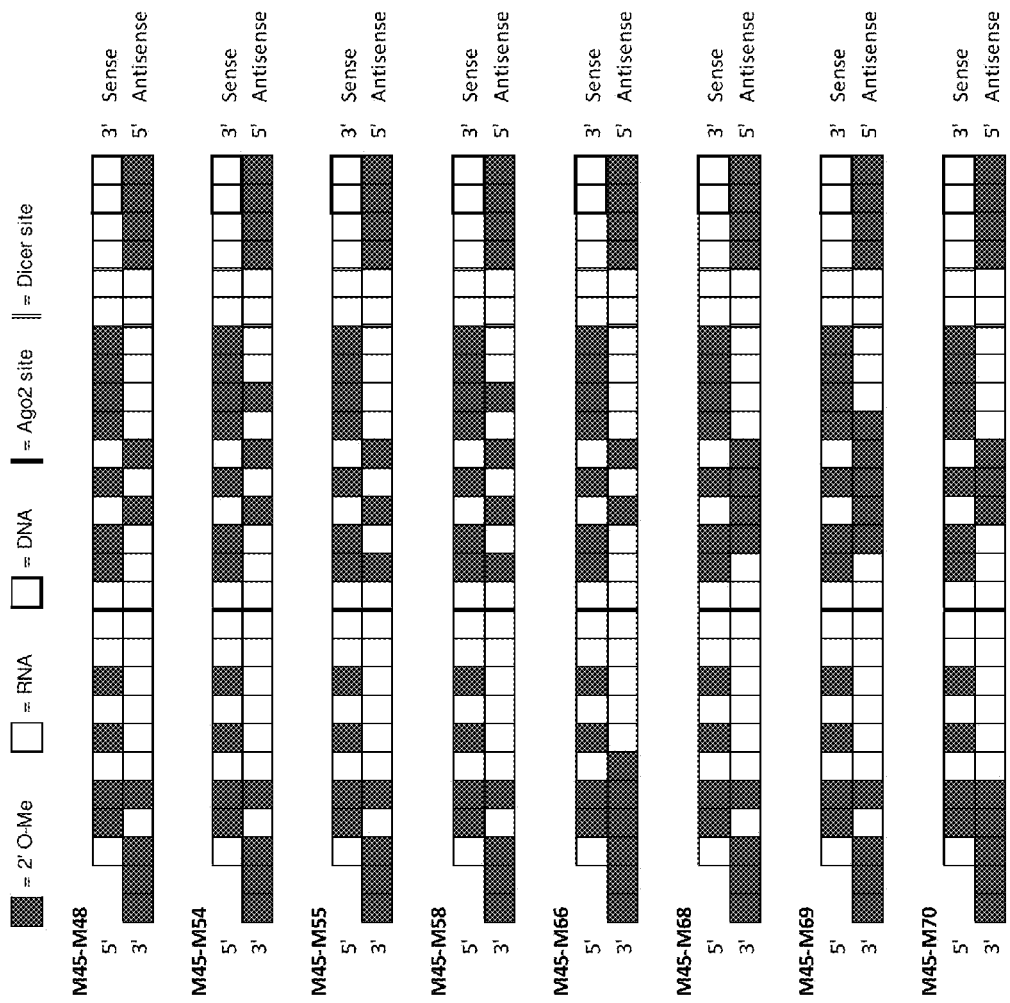
Figure 7F:
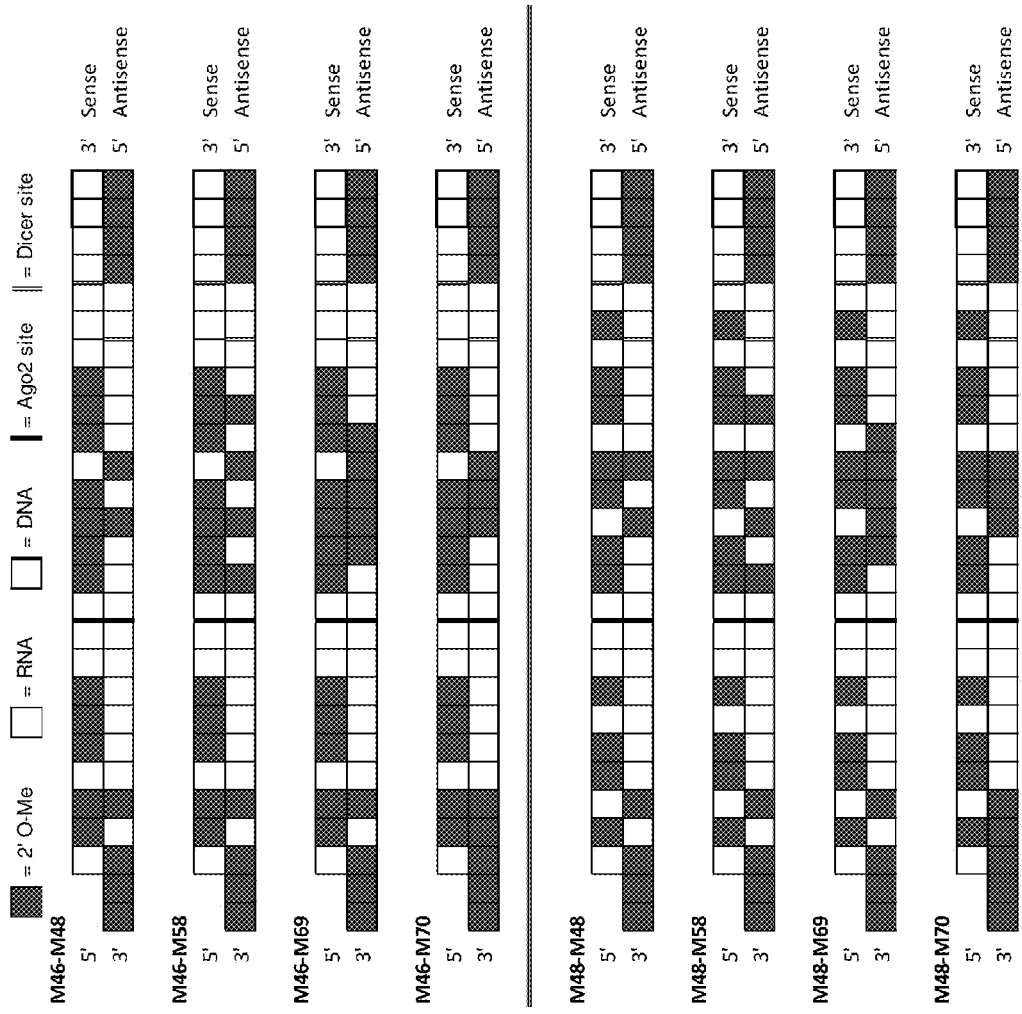
Figure 7G:
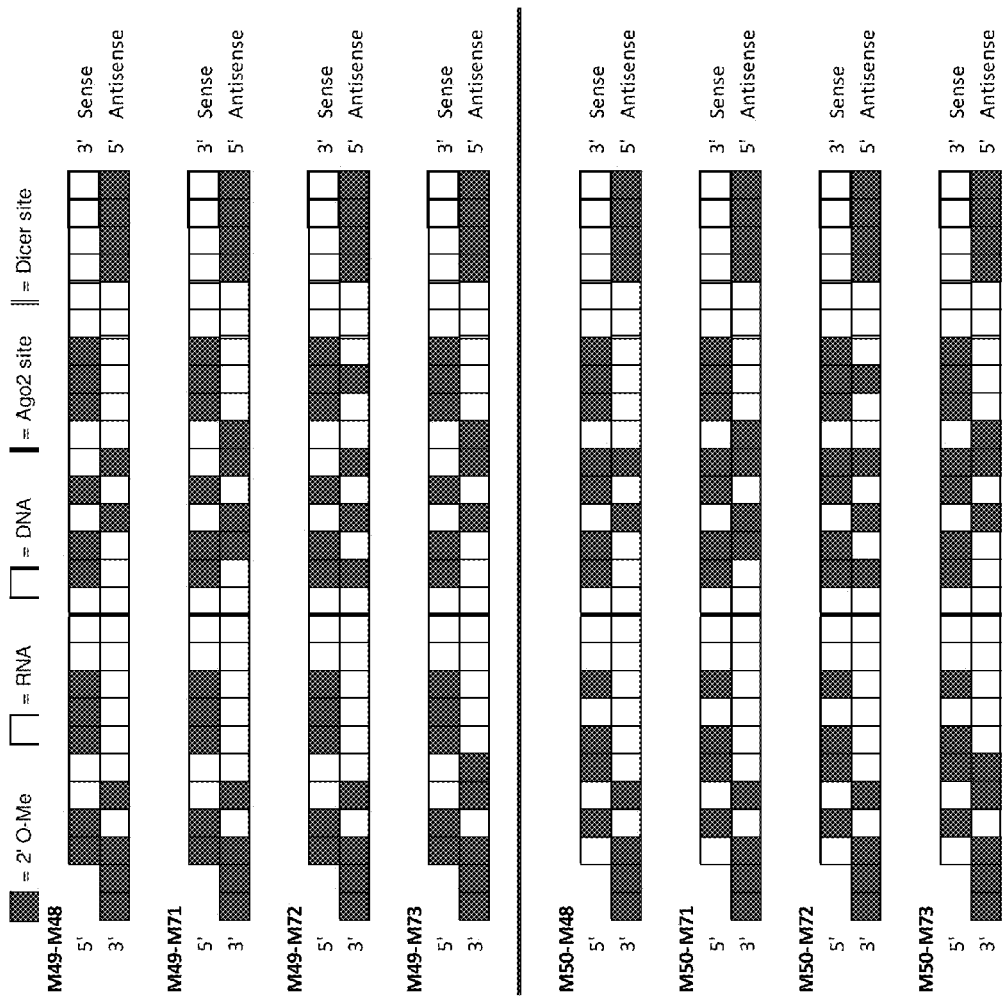
Figure 7H:
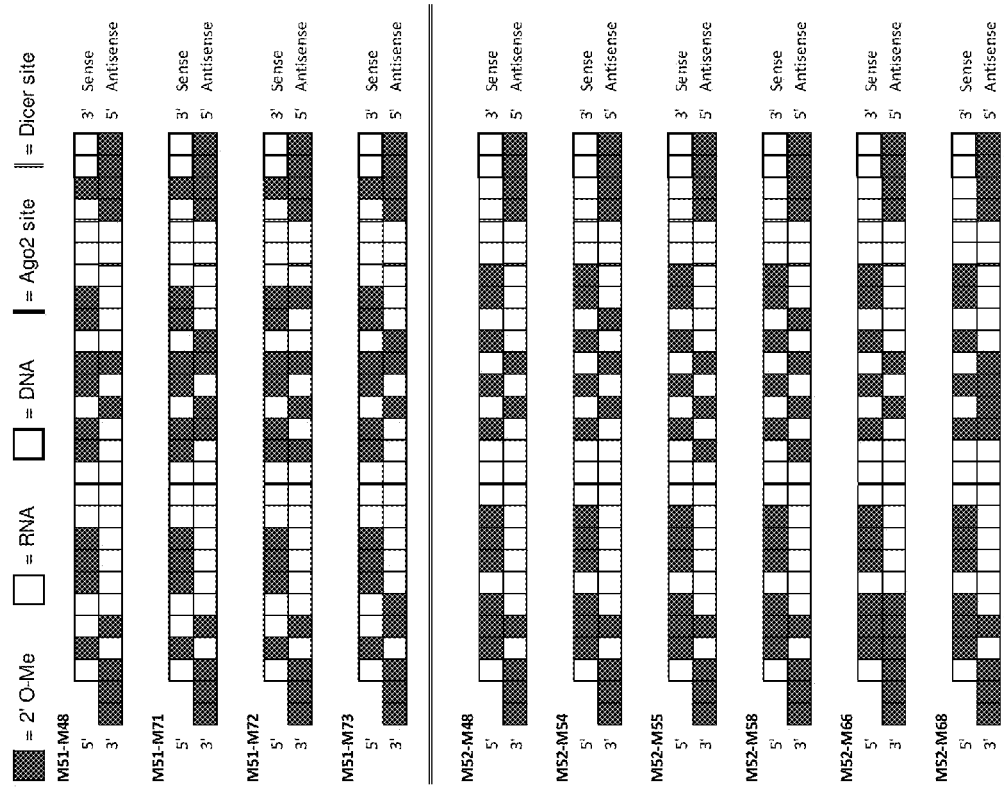
Figure 7J:
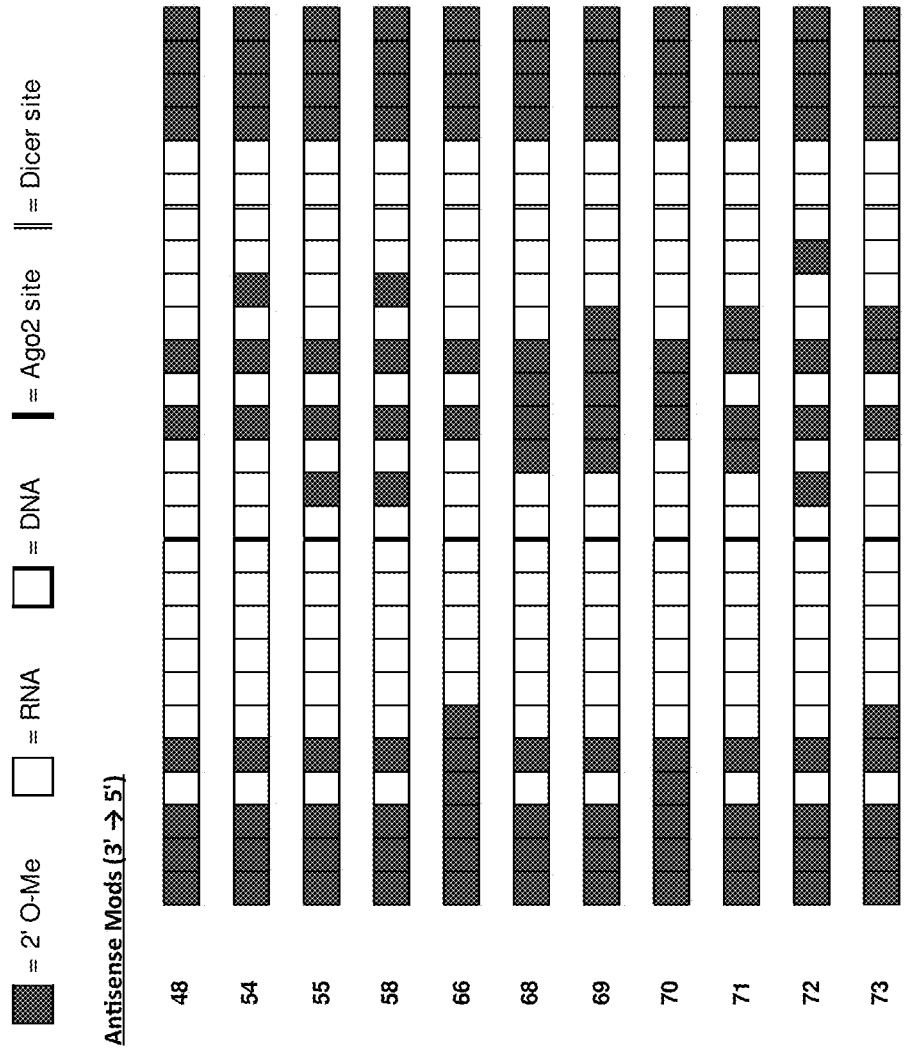

Three MYC-targeting duplex sequences (MYC-622, MYC-953 and MYC-1711) were further examined for robustness of anti-MYC activity while possessing varying modifications of both sense and antisense strands (as described above, also see FIGS. 7A to 7H for schematics of duplex modification patterns used, and FIGS. 7I and 7J for schematics of individual sense and antisense strand modification patterns, respectively). As shown in FIGS. 7K and 7L, a number of highly modified forms of each of the MYC-622, MYC-953 and MYC 1711 duplexes were identified to possess robust inhibitory activity, with many such newly-tested modified duplexes improving upon the level of activity observed for M12-M48-modified duplexes in "Phase 5" (described above). Thus, many highly modified and robustly active MYC duplexes were identified.

Example 8

In Vivo Efficacy of MYC-Targeting DsiRNAs

Figure 8:
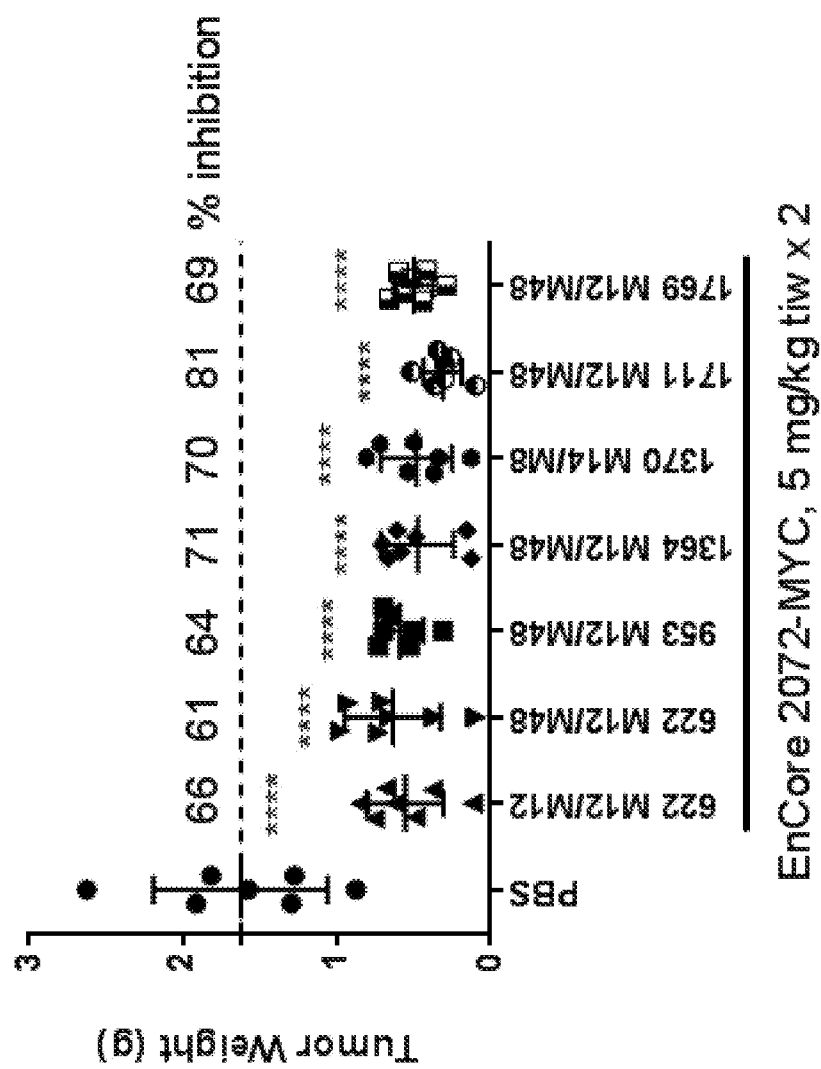
FIG. 8 presents in vivo efficacy data for lipid nanoparticle (LNP)-formulated exemplary MYC-targeting duplexes possessing 2'-O-methyl modification patterns of both guide and passenger strands, in mice bearing human Hep3B tumors.

The ability of certain, active MYC-targeting DsiRNAs to reduce tumor burden within two orthotopic models of human hepatocellular carcinoma (HCC), Hep3B and HepG2, was examined. To perform such experiments, male nude mice were orthotopically implanted with $2\times10^6$ Hep3B cells (ATCC) in 50% Matrigel. On day 12 post-implant, serum was collected for human alpha-fetoprotein (AFP) analysis (human AFP is a serum marker indicative of the establishment and progression of HCC tumors, e.g., Hep3B and HepG2 tumors). Animals were randomized and assigned to groups based on AFP levels (n=7/group). Dosing of animals with lipid nanoparticles (LNPs) containing DsiRNAs (here, an LNP formulation named EnCore-2072 was employed) was initiated on day 13. Animals were dosed at 5 mg/kg iv, tiw×2 (6 doses total). Animals were sacrificed on 48 hrs after the last dose (day 27 post implant). Tumors were dissected from the liver and weighed. As shown in FIG. 8, all MYC-targeting DsiRNAs examined showed significant tumor reduction as compared to untreated subjects. Specifically, indicated modified forms of all tested MYC-targeting DsiRNAs MYC-622, MYC-953, MYC-1364, MYC-1370, MYC-1711 and MYC-1769 exhibited tumor inhibition magnitudes of between 61% and 81% as compared to PBS-treated control subjects. Consistent with these levels of Hep3B tumor reduction, a reduction in AFP levels was also observed (data not shown). Notably, DsiRNAs targeting both human and mouse MYC and DsiRNAs targeting only human MYC showed effective reduction of tumor levels, confirming that the observed effect was attributable to DsiRNA-mediated targeting of human MYC.

Figure 9:
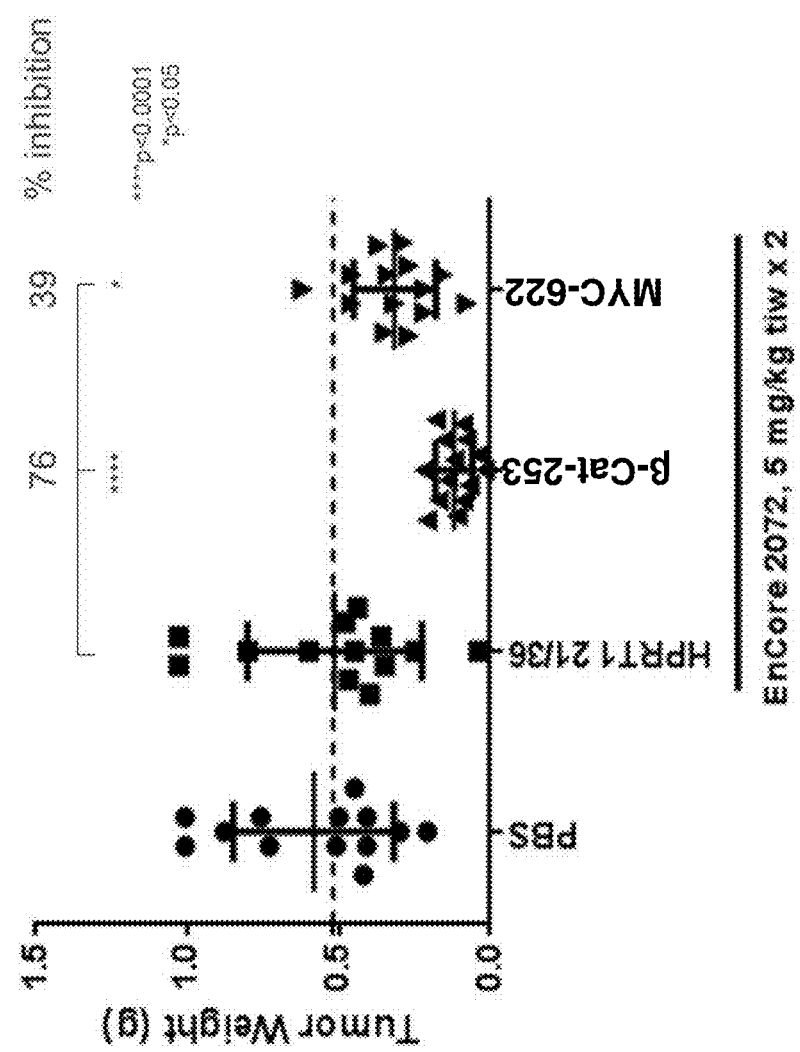
FIG. 9 shows in vivo efficacy data for exemplary lipid nanoparticle (LNP)-formulated β-Catenin- and MYC-targeting duplexes, respectively, in mice bearing human HepG2 tumors.

The ability of MYC-targeting DsiRNAs to reduce tumor burden in a HepG2 model of HCC was also examined. In these experiments, male nude mice were orthotopically implanted with $3\times10^6$ HepG2 cells (ATCC) in 50% Matrigel. On day 12 post implant, serum was collected for AFP analysis. Animals were randomized and assigned to groups based on AFP levels (n=15/group). Dosing of animals with lipid nanoparticles (LNPs) containing DsiRNAs (here, an LNP formulation named EnCore-2072 was employed) was initiated on day 13. Animals were dosed at 5 mg/kg iv, tiw×2 (7 doses total). Animals were sacrificed on 48 hrs after the last dose (day 29 post implant). Tumors were dissected from the liver and weighed. As shown in FIG. 9, significant reduction of HepG2 tumor burden was observed in mice administered either a β-catenin-targeting DsiRNA (HepG2 is known to be β-catenin-dependent) or a MYC-622 DsiRNA. Here, the extent of tumor reduction was compared to a DsiRNA targeting the HPRT1 housekeeping gene, with such comparison indicating a significant, 39% reduction of tumor burden in MYC-622 DsiRNA-treated mice. Such reduction in tumor levels again correlated with an observed reduction in AFP levels (data not shown).

Thus, treatment of established tumors with MYC-targeting DsiRNAs reduced tumor burden and AFP levels in two different models of liver cancer (here, Hep3B and HepG2 tumors were used as art-recognized models of human HCC).

In additional experiments, dose-dependence of treatment of Hep3B tumors was observed in progressing from 1 mg/kg to 2 mg/kg to 5 mg/kg levels of DsiRNA formulations (data not shown). It was also observed that administration of MYC-targeting DsiRNAs to Hep3B tumor bearing mice induced greater reduction of tumor burden than was observed for sorafenib when either agent was administered individually, and that MYC-targeting DsiRNAs were effective inhibitors of tumor burden when both sorafenib and MYC-targeting DsiRNAs were administered in the Hep3B tumor model—indeed such a combination was well-tolerated, with no significant weight loss or reduction in spleen or liver weights observed in such combination therapy-treated mice (data not shown). Administration of MYC-targeting DsiRNAs to Hep3B tumor bearing mice was also confirmed to reduce both MYC transcript and protein levels in such tumors in dose-dependent fashion, as well as levels of LDHA protein (LDHA is downstream of MYC in the MYC signaling pathway). MYC DsiRNAs were also confirmed to have low immunostimulatory potential, as identified in assays for PEG IgM induction, where all MYC-targeting DsiRNAs formulated in LNP formulation EnCore 2072 did not induce PEG IgM to any greater extent than PBS-treated animals, while even when formulated in an LNP designed to be immunostimulatory, most MYC-targeting DsiRNAs showed no induction of PEG IgM as compared to mock-treated animals (data not shown). $IC_{50}$ values were also calculated for MYC-targeting DsiRNAs and were observed to be in the range of 5-50 pM in both Hep3B and Hepa 1-6 cells.

Thus, potent DsiRNAs against MYC have been identified, with such DsiRNAs possessing picomolar mRNA knockdown activity when transfected into Hep3B cells. Meanwhile, many such DsiRNAs when modified with 2'-O-methyl groups were observed to have low immunostimulatory potential in vivo. Further, LNP-formulated MYC-targeting DsiRNAs were found to be efficacious in in vivo models of human hepatocellular carcinoma (here, Hep3B and HepG2 tumor models), where MYC-targeting DsiRNAs were identified to produce significant tumor reduction of established orthotopic HepG2 and Hep3B tumors. It was also confirmed that knockdown of tumor-derived MYC mRNA was sufficient for anti-tumor activity, and that such activity was dose-dependent and observed with multiple distinct DsiRNAs. In addition, reduced MYC mRNA, Myc protein and downstream LDHA protein levels correlated with such anti-tumor activity. Such treatment was also observed to be well-tolerated in combination with sorafenib. Accordingly, MYC-targeting DsiRNAs exhibited potent in vitro and in vivo MYC mRNA knockdown activity and demonstrated significant anti-tumor activity in the HepG2 and Hep3B orthotopic tumor models. Such results provide a rationale for the clinical evaluation of DsiRNA molecules against MYC, a traditionally "undruggable" target, in patients with advanced HCC.

Example 9

Indications

The present body of knowledge in MYC research indicates the need for methods to assay MYC activity and for compounds that can regulate MYC expression for research, diagnostic, and therapeutic use. As described herein, the nucleic acid molecules of the present invention can be used in assays to diagnose disease state related to MYC levels. In addition, the nucleic acid molecules can be used to treat disease state related to MYC misregulation, levels, etc.

Particular disorders and disease states that can be associated with MYC expression modulation include, but are not limited to cancer and/or proliferative diseases, conditions, or disorders and other diseases, conditions or disorders that are related to or will respond to the levels of MYC in a cell or tissue, alone or in combination with other therapies, such as other immune cell-related disorders (e.g. inflammatory or autoimmune disorders). Particular degenerative and disease states that are associated with MYC expression modulation include but are not limited to, for example, renal, breast, lung, liver, ovarian, cervical, esophageal, oropharyngeal and pancreatic cancer.

Gemcitabine and cyclophosphamide are non-limiting examples of chemotherapeutic agents that can be combined with or used in conjunction with the nucleic acid molecules (e.g. DsiRNA molecules) of the instant invention. Those skilled in the art will recognize that other drugs such as anti-cancer compounds and therapies can be similarly be readily combined with the nucleic acid molecules of the instant invention (e.g. DsiRNA molecules) and are hence within the scope of the instant invention. Such compounds and therapies are well known in the art (see for example Cancer: Principles and Practice of Oncology, Volumes 1 and 2, eds Devita, V. T., Hellman, S., and Rosenberg, S. A., J.B. Lippincott Company, Philadelphia, USA) and include, without limitations, antifolates; fluoropyrimidines; cytarabine; purine analogs; adenosine analogs; amsacrine; topoisomerase I inhibitors; anthrapyrazoles; retinoids; antibiotics such as bleomycin, anthacyclins, mitomycin C, dactinomycin, and mithramycin; hexamethylmelamine; dacarbazine; 1-asperginase; platinum analogs; alkylating agents such as nitrogen mustard, melphalan, chlorambucil, busulfan, ifosfamide, 4-hydroperoxycyclophosphamide, nitrosoureas, thiotepa; plant derived compounds such as vinca alkaloids, epipodophyllotoxins, taxol; Tamoxifen; radiation therapy; surgery; nutritional supplements; gene therapy; radiotherapy such as 3D-CRT; immunotoxin therapy such as ricin, monoclonal antibodies such as Herceptin; other therapeutics such as tarceva, sorafenib, obatoclax, apogossypolone, and navitoclax, and the like. For combination therapy, the nucleic acids of the invention are prepared in one of two ways. First, the agents are physically combined in a preparation of nucleic acid and chemotherapeutic agent, such as a mixture of a nucleic acid of the invention encapsulated in liposomes and ifosfamide in a solution for intravenous administration, wherein both agents are present in a therapeutically effective concentration (e.g., ifosfamide in solution to deliver 1000-1250 mg/m2/day and liposome-associated nucleic acid of the invention in the same solution to deliver 0.1-100 mg/kg/day). Alternatively, the agents are administered separately but simultaneously or successively in their respective effective doses (e.g., 1000-1250 mg/m2/d ifosfamide and 0.1 to 100 mg/kg/day nucleic acid of the invention).

Those skilled in the art will recognize that other compounds and therapies used to treat the diseases and conditions described herein can similarly be combined with the nucleic acid molecules of the instant invention (e.g. siNA molecules) and are hence within the scope of the instant invention.

Example 10

Serum Stability for DsiRNAs

Serum stability of DsiRNA agents is assessed via incubation of DsiRNA agents in 50% fetal bovine serum for various periods of time (up to 24 h) at 37° C. Serum is extracted and the nucleic acids are separated on a 20% non-denaturing PAGE and can be visualized with Gelstar stain. Relative levels of protection from nuclease degradation are assessed for DsiRNAs (optionally with and without modifications).

Example 11

Use of Additional Cell Culture Models to Evaluate the Down-Regulation of MYC Gene Expression A variety of endpoints have been used in cell culture models to look at MYC-mediated effects after treatment with anti-MYC agents. Phenotypic endpoints include inhibition of cell proliferation, RNA expression, and reduction of Myc protein expression. Because MYC mutations are directly associated with increased growth of certain tumor cells, a growth endpoint for cell culture assays can be used as a screen. There are several methods by which this endpoint can be measured. Following treatment of cells with DsiRNA, cells are allowed to grow (typically 5 days), after which the cell viability, the incorporation of bromodeoxyuridine (BrdU) into cellular DNA and/or the cell density are measured. The assay of cell density can be done in a 96-well format using commercially available fluorescent nucleic acid stains (such as Syto® 13 or CyQuant®). As a secondary, confirmatory endpoint, a DsiRNA-mediated decrease in the level of Myc protein expression can be evaluated using a MYC-specific Western assay. The following are exemplary cell lines for use in such assays (e.g., assays performed as described in Schulze-Bergkamen et al., BMC Cancer 2006, 6:232, for detection of Mcl-1 expression): A549, H1299, HepG2, SNU398, A549, NCI-H196, NCI-H1975, MDA-MB-231, NCI-H441, Panc-1, MiaPaCa, BxPC3, DU-145, VCaP, MCF-7, U937, K562, HeLa, or T98G cells.

Example 12

Evaluation of Anti-MYC DsiRNA Efficacy in Additional Mouse Models of MYC Misregulation Anti-MYC DsiRNA chosen from in vitro assays can be further tested in mouse models, including, e.g., xenograft and other animal models as recited above. As referred to above, exemplary appropriate cell lines for use in xenograft assays include HT1080, HCT116, SW480, SW620, Hep3B, M14, JR8, PLF2, LLC1, LNCaP, PC3, SUM159, MDAMB-231, 22Rv1, 518A2, MHCC97, A549, H1299, HepG2, SNU398, HuH7, NCI-H196, NCI-H1975, HT29, MKN-45, MDA-MB-231, NCI-H441, Panc-1, MiaPaCa2, BxPC3, DU-145, M2182, VCaP, OvCar-3, MCF-7, U937, K562, HeLa, T98G, or SHP-77. In one example, mice possessing misregulated (e.g., elevated) MYC levels are administered a DsiRNA agent of the present invention via hydrodynamic tail vein injection and/or lipid nanoparticle-based delivery modality. 3-4 mice per group (divided based upon specific DsiRNA agent tested) are injected with 50 μg or 200 μg of DsiRNA. Levels of MYC RNA are evaluated using RT-qPCR. Additionally or alternatively, levels of MYC (e.g., Myc protein levels and/or cancer cell/tumor formation, growth or spread) can be evaluated using an art-recognized method, or phenotypes associated with misregulation of MYC (e.g., tumor formation, growth, metastasis, etc.) are monitored (optionally as a proxy for measurement of MYC transcript or Myc protein levels). Active DsiRNA in such animal models can also be subsequently tested in combination with standard chemotherapies.

Example 13

Diagnostic Uses

The DsiRNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of DsiRNA molecules involves utilizing reconstituted RNAi systems, for example, using cellular lysates or partially purified cellular lysates. DsiRNA molecules of this invention can be used as diagnostic tools to examine genetic drift and mutations within diseased cells. The close relationship between DsiRNA activity and the structure of the target MYC RNA allows the detection of mutations in a region of the MYC molecule, which alters the base-pairing and three-dimensional structure of the target MYC RNA. By using multiple DsiRNA molecules described in this invention, one can map nucleotide changes, which are important to RNA structure and function in vitro, as well as in cells and tissues. Cleavage of target MYC RNAs with DsiRNA molecules can be used to inhibit gene expression and define the role of specified gene products in the progression of a MYC-associated disease or disorder. In this manner, other genetic targets can be defined as important mediators of the disease. These experiments will lead to better treatment of the disease progression by affording the possibility of combination therapies (e.g., multiple DsiRNA molecules targeted to different genes, DsiRNA molecules coupled with known small molecule inhibitors, or intermittent treatment with combinations of DsiRNA molecules and/or other chemical or biological molecules). Other in vitro uses of DsiRNA molecules of this invention are well known in the art, and include detection of the presence of RNAs associated with a disease or related condition. Such RNA is detected by determining the presence of a cleavage product after treatment with a DsiRNA using standard methodologies, for example, fluorescence resonance emission transfer (FRET).

In a specific example, DsiRNA molecules that cleave only wild-type or mutant or polymorphic forms of the target MYC RNA are used for the assay. The first DsiRNA molecules (i.e., those that cleave only wild-type forms of target MYC RNA) are used to identify wild-type MYC RNA present in the sample and the second DsiRNA molecules (i.e., those that cleave only mutant or polymorphic forms of target RNA) are used to identify mutant or polymorphic MYC RNA in the sample. As reaction controls, synthetic substrates of both wild-type and mutant or polymorphic MYC RNA are cleaved by both DsiRNA molecules to demonstrate the relative DsiRNA efficiencies in the reactions and the absence of cleavage of the "non-targeted" MYC RNA species. The cleavage products from the synthetic substrates also serve to generate size markers for the analysis of wild-type and mutant MYC RNAs in the sample population. Thus, each analysis requires two DsiRNA molecules, two substrates and one unknown sample, which is combined into six reactions. The presence of cleavage products is determined using an RNase protection assay so that full-length and cleavage fragments of each MYC RNA can be analyzed in one lane of a polyacrylamide gel. It is not absolutely required to quantify the results to gain insight into the expression of mutant or polymorphic MYC RNAs and putative risk of MYC-associated phenotypic changes in target cells. The expression of MYC mRNA whose protein product is implicated in the development of the phenotype (i.e., disease related/associated) is adequate to establish risk. If probes of comparable specific activity are used for both transcripts, then a qualitative comparison of MYC RNA levels is adequate and decreases the cost of the initial diagnosis. Higher mutant or polymorphic form to wild-type ratios are correlated with higher risk whether MYC RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (3928 sequences)

SEQ ID NO: 1 - DNA, 25 bp, Artificial Sequence
  Synthetic oligonucleotide
cgagaagggcagggcuucucagagg

SEQ ID NO: 2 - DNA, 25 bp, Artificial Sequence
  Synthetic oligonucleotide
gcuuuaucuaacucgcuguaguaat

SEQ ID NO: 3 - DNA, 25 bp, Artificial Sequence
  Synthetic oligonucleotide
cccuugccgcauccacgaaacuutg

SEQ ID NO: 4 - DNA, 25 bp, Artificial Sequence
  Synthetic oligonucleotide
gccgcauccacgaaacuuugcccat

SEQ ID NO: 5 - DNA, 25 bp, Artificial Sequence
  Synthetic oligonucleotide
uccacgaaacuuugcccauagcagc

SEQ ID NO: 6 - DNA, 25 bp, Artificial Sequence
  Synthetic oligonucleotide
gcgggcacuuugcacuggaacuuac

SEQ ID NO: 7 - DNA, 25 bp, Artificial Sequence
  Synthetic oligonucleotide
acuuugcacuggaacuuacaacacc

SEQ ID NO: 8 - DNA, 25 bp, Artificial Sequence
  Synthetic oligonucleotide
cuggaacuuacaacacccgagcaag

SEQ ID NO: 9 - DNA, 25 bp, Artificial Sequence
  Synthetic oligonucleotide
gcagcugcuuagacgcuggauuutt

SEQ ID NO: 10 - DNA, 25 bp, Artificial Sequence
  Synthetic oligonucleotide
gcuuagacgcuggauuuuuuucggg

SEQ ID NO: 11 - DNA, 25 bp, Artificial Sequence
  Synthetic oligonucleotide
cgcuggauuuuuuucggguagugga

SEQ ID NO: 12 - DNA, 25 bp, Artificial Sequence
  Synthetic oligonucleotide
gauuuuuuucggguaguggaaaacc

SEQ ID NO: 13 - DNA, 25 bp, Artificial Sequence
  Synthetic oligonucleotide
cggguaguggaaaaccagcagcctc

SEQ ID NO: 14 - DNA, 25 bp, Artificial Sequence
  Synthetic oligonucleotide
cucaacguuagcuucaccaacagga

SEQ ID NO: 15 - DNA, 25 bp, Artificial Sequence
  Synthetic oligonucleotide
guuagcuucaccaacaggaacuatg

SEQ ID NO: 16 - DNA, 25 bp, Artificial Sequence
  Synthetic oligonucleotide
gacucggugcagccguauuucuact

SEQ ID NO: 17 - DNA, 25 bp, Artificial Sequence
  Synthetic oligonucleotide
gcagccguauuucuacugcgacgag

SEQ ID NO: 18 - DNA, 25 bp, Artificial Sequence
  Synthetic oligonucleotide
gaggagaacuucuaccagcagcagc

SEQ ID NO: 19 - DNA, 25 bp, Artificial Sequence
  Synthetic oligonucleotide
gcgaggauaucuggaagaaauucga

SEQ ID NO: 20 - DNA, 25 bp, Artificial Sequence
  Synthetic oligonucleotide
cguugcggucacacccuucuccctt

SEQ ID NO: 21 - DNA, 25 bp, Artificial Sequence
  Synthetic oligonucleotide
acauggugaaccagaguuucauctg

SEQ ID NO: 22 - DNA, 25 bp, Artificial Sequence
  Synthetic oligonucleotide
ccggacgacgagaccuucaucaaaa

SEQ ID NO: 23 - DNA, 25 bp, Artificial Sequence
  Synthetic oligonucleotide
gagaccuucaucaaaaacaucauca

SEQ ID NO: 24 - DNA, 25 bp, Artificial Sequence
  Synthetic oligonucleotide
aaaaacaucaucauccaggacugta

SEQ ID NO: 25 - DNA, 25 bp, Artificial Sequence
  Synthetic oligonucleotide
ggacuguauguggagcggcuucucg

SEQ ID NO: 26 - DNA, 25 bp, Artificial Sequence
  Synthetic oligonucleotide
cugcuccaccuccagcuuguacctg

SEQ ID NO: 27 - DNA, 25 bp, Artificial Sequence
  Synthetic oligonucleotide
accuccagcuuguaccugcaggatc

SEQ ID NO: 28 - DNA, 25 bp, Artificial Sequence
  Synthetic oligonucleotide
cagcuuguaccugcaggaucugagc

SEQ ID NO: 29 - DNA, 25 bp, Artificial Sequence
  Synthetic oligonucleotide
aaguccugcgccucgcaagacucca

SEQ ID NO: 30 - DNA, 25 bp, Artificial Sequence
  Synthetic oligonucleotide
gcagcgacucugaggaggaacaaga

SEQ ID NO: 31 - DNA, 25 bp, Artificial Sequence
  Synthetic oligonucleotide
acucugaggaggaacaagaagauga

SEQ ID NO: 32 - DNA, 25 bp, Artificial Sequence
  Synthetic oligonucleotide
gaggaggaacaagaagaugaggaag

SEQ ID NO: 33 - DNA, 25 bp, Artificial Sequence
  Synthetic oligonucleotide
aacaagaagaugaggaagaaaucga

SEQ ID NO: 34 - DNA, 25 bp, Artificial Sequence
  Synthetic oligonucleotide
aagaugaggaagaaaucgauguugt

SEQ ID NO: 35 - DNA, 25 bp, Artificial Sequence
  Synthetic oligonucleotide
aggaagaaaucgauguuguuucugt

SEQ ID NO: 36 - DNA, 25 bp, Artificial Sequence
  Synthetic oligonucleotide
aaaucgauguuguuucuguggaaaa

SEQ ID NO: 37 - DNA, 25 bp, Artificial Sequence
  Synthetic oligonucleotide
auguuguuucuguggaaaagaggca

SEQ ID NO: 38 - DNA, 25 bp, Artificial Sequence
  Synthetic oligonucleotide
gaggcaggcuccuggcaaaagguca

SEQ ID NO: 39 - DNA, 25 bp, Artificial Sequence
  Synthetic oligonucleotide
aggcuccuggcaaaaggucagagtc

SEQ ID NO: 40 - DNA, 25 bp, Artificial Sequence
  Synthetic oligonucleotide
ccuggcaaaaggucagagucuggat

SEQ ID NO: 41 - DNA, 25 bp, Artificial Sequence
  Synthetic oligonucleotide
caaaaggucagagucuggaucacct

SEQ ID NO: 42 - DNA, 25 bp, Artificial Sequence
  Synthetic oligonucleotide
ggucagagucuggaucaccuucugc

SEQ ID NO: 43 - DNA, 25 bp, Artificial Sequence
  Synthetic oligonucleotide
gcaaaccuccucacagcccacuggt

SEQ ID NO: 44 - DNA, 25 bp, Artificial Sequence
  Synthetic oligonucleotide
ccucacagcccacugguccucaaga

SEQ ID NO: 45 - DNA, 25 bp, Artificial Sequence
  Synthetic oligonucleotide
cccuccacucggaaggacuaucctg

SEQ ID NO: 46 - DNA, 25 bp, Artificial Sequence
  Synthetic oligonucleotide
cucggaaggacuauccugcugccaa

SEQ ID NO: 47 - DNA, 25 bp, Artificial Sequence
  Synthetic oligonucleotide
auccugcugccaagagggucaagtt

SEQ ID NO: 48 - DNA, 25 bp, Artificial Sequence
  Synthetic oligonucleotide
gcugccaagagggucaaguuggaca

SEQ ID NO: 49 - DNA, 25 bp, Artificial Sequence
  Synthetic oligonucleotide
caagagggucaaguuggacagugtc

SEQ ID NO: 50 - DNA, 25 bp, Artificial Sequence
  Synthetic oligonucleotide
gggucaaguuggacagugucagagt

SEQ ID NO: 51 - DNA, 25 bp, Artificial Sequence
  Synthetic oligonucleotide
aaguuggacagugucagaguccuga

SEQ ID NO: 52 - DNA, 25 bp, Artificial Sequence
  Synthetic oligonucleotide
ggacagugucagaguccugagacag

SEQ ID NO: 53 - DNA, 25 bp, Artificial Sequence
  Synthetic oligonucleotide
cagaguccugagacagaucagcaac

SEQ ID NO: 54 - DNA, 25 bp, Artificial Sequence
  Synthetic oligonucleotide
gagacagaucagcaacaaccgaaaa

SEQ ID NO: 55 - DNA, 25 bp, Artificial Sequence
  Synthetic oligonucleotide
gaucagcaacaaccgaaaaugcacc

SEQ ID NO: 56 - DNA, 25 bp, Artificial Sequence
  Synthetic oligonucleotide
ccucggacaccgaggagaaugucaa

SEQ ID NO: 57 - DNA, 25 bp, Artificial Sequence
  Synthetic oligonucleotide
gacaccgaggagaaugucaagaggc

SEQ ID NO: 58 - DNA, 25 bp, Artificial Sequence
  Synthetic oligonucleotide
cagaggaggaacgagcuaaaacgga

SEQ ID NO: 59 - DNA, 25 bp, Artificial Sequence
  Synthetic oligonucleotide
aggaacgagcuaaaacggagcuutt

SEQ ID NO: 60 - DNA, 25 bp, Artificial Sequence
  Synthetic oligonucleotide
cgagcuaaaacggagcuuuuuugcc

SEQ ID NO: 61 - DNA, 25 bp, Artificial Sequence
  Synthetic oligonucleotide
aaaacggagcuuuuuugcccugcgt

SEQ ID NO: 62 - DNA, 25 bp, Artificial Sequence
  Synthetic oligonucleotide
ggagcuuuuuugcccugcgugacca

SEQ ID NO: 63 - DNA, 25 bp, Artificial Sequence
  Synthetic oligonucleotide
gaccagaucccggaguuggaaaaca

SEQ ID NO: 64 - DNA, 25 bp, Artificial Sequence
  Synthetic oligonucleotide
gaucccggaguuggaaaacaaugaa

SEQ ID NO: 65 - DNA, 25 bp, Artificial Sequence
  Synthetic oligonucleotide
cggaguuggaaaacaaugaaaaggc

SEQ ID NO: 66 - DNA, 25 bp, Artificial Sequence
  Synthetic oligonucleotide
agguaguuauccuuaaaaaagccac

SEQ ID NO: 67 - DNA, 25 bp, Artificial Sequence
  Synthetic oligonucleotide
guuauccuuaaaaaagccacagcat

SEQ ID NO: 68 - DNA, 25 bp, Artificial Sequence
  Synthetic oligonucleotide
ccuuaaaaaagccacagcauacatc

SEQ ID NO: 69 - DNA, 25 bp, Artificial Sequence
  Synthetic oligonucleotide
aaaaagccacagcauacauccugtc

SEQ ID NO: 70 - DNA, 25 bp, Artificial Sequence
  Synthetic oligonucleotide
gccacagcauacauccuguccgucc

SEQ ID NO: 71 - DNA, 25 bp, Artificial Sequence
  Synthetic oligonucleotide
gcauacauccuguccguccaagcag

SEQ ID NO: 72 - DNA, 25 bp, Artificial Sequence
  Synthetic oligonucleotide
ccuguccguccaagcagaggagcaa

SEQ ID NO: 73 - DNA, 25 bp, Artificial Sequence
  Synthetic oligonucleotide
ccguccaagcagaggagcaaaagct

SEQ ID NO: 74 - DNA, 25 bp, Artificial Sequence
  Synthetic oligonucleotide
gcagaggagcaaaagcucauuuctg

SEQ ID NO: 75 - DNA, 25 bp, Artificial Sequence
  Synthetic oligonucleotide
agcaaaagcucauuucugaagagga

SEQ ID NO: 76 - DNA, 25 bp, Artificial Sequence
  Synthetic oligonucleotide
aagcucauuucugaagaggacuugt

SEQ ID NO: 77 - DNA, 25 bp, Artificial Sequence
  Synthetic oligonucleotide
auuucugaagaggacuuguugcgga

SEQ ID NO: 78 - DNA, 25 bp, Artificial Sequence
  Synthetic oligonucleotide
gaagaggacuuguugcggaaacgac

SEQ ID NO: 79 - DNA, 25 bp, Artificial Sequence
  Synthetic oligonucleotide
ggacuuguugcggaaacgacgagaa

SEQ ID NO: 80 - DNA, 25 bp, Artificial Sequence
  Synthetic oligonucleotide
uguugcggaaacgacgagaacagtt

SEQ ID NO: 81 - DNA, 25 bp, Artificial Sequence
  Synthetic oligonucleotide
cggaaacgacgagaacaguugaaac

SEQ ID NO: 82 - DNA, 25 bp, Artificial Sequence
  Synthetic oligonucleotide
aaacuugaacagcuacggaacuctt

SEQ ID NO: 83 - DNA, 25 bp, Artificial Sequence
  Synthetic oligonucleotide
gaacagcuacggaacucuugugcgt

SEQ ID NO: 84 - DNA, 25 bp, Artificial Sequence
  Synthetic oligonucleotide
gcuacggaacucuugugcguaagga

SEQ ID NO: 85 - DNA, 25 bp, Artificial Sequence
  Synthetic oligonucleotide
aacucuugugcguaaggaaaaguaa

SEQ ID NO: 86 - DNA, 25 bp, Artificial Sequence
  Synthetic oligonucleotide
ugugcguaaggaaaaguaaggaaaa

SEQ ID NO: 87 - DNA, 25 bp, Artificial Sequence
  Synthetic oligonucleotide
guaaggaaaaguaaggaaaacgatt

SEQ ID NO: 88 - DNA, 25 bp, Artificial Sequence
  Synthetic oligonucleotide
guaaggaaaacgauuccuucuaaca

SEQ ID NO: 89 - DNA, 25 bp, Artificial Sequence
  Synthetic oligonucleotide
gaaaacgauuccuucuaacagaaat

SEQ ID NO: 90 - DNA, 25 bp, Artificial Sequence
  Synthetic oligonucleotide
cgauuccuucuaacagaaaugucct

SEQ ID NO: 91 - DNA, 25 bp, Artificial Sequence
  Synthetic oligonucleotide
cuucuaacagaaauguccugagcaa

SEQ ID NO: 92 - DNA, 25 bp, Artificial Sequence
  Synthetic oligonucleotide
cagaaauguccugagcaaucaccta

SEQ ID NO: 93 - DNA, 25 bp, Artificial Sequence
  Synthetic oligonucleotide
ccugagcaaucaccuaugaacuugt

SEQ ID NO: 94 - DNA, 25 bp, Artificial Sequence
  Synthetic oligonucleotide
caaucaccuaugaacuuguuucaaa

SEQ ID NO: 95 - DNA, 25 bp, Artificial Sequence
  Synthetic oligonucleotide
ccuaugaacuuguuucaaaugcatg

SEQ ID NO: 96 - DNA, 25 bp, Artificial Sequence
  Synthetic oligonucleotide
gaacuuguuucaaaugcaugaucaa

SEQ ID NO: 97 - DNA, 25 bp, Artificial Sequence
  Synthetic oligonucleotide
guuucaaaugcaugaucaaaugcaa

SEQ ID NO: 98 - DNA, 25 bp, Artificial Sequence
  Synthetic oligonucleotide
aaaugcaugaucaaaugcaaccuca

SEQ ID NO: 99 - DNA, 25 bp, Artificial Sequence
  Synthetic oligonucleotide
gaucaaaugcaaccucacaaccutg

SEQ ID NO: 100 - DNA, 25 bp, Artificial Sequence
  Synthetic oligonucleotide
aaugcaaccucacaaccuuggcuga

SEQ ID NO: 101 - DNA, 25 bp, Artificial Sequence
  Synthetic oligonucleotide
ccucacaaccuuggcugagucuuga

SEQ ID NO: 102 - DNA, 25 bp, Artificial Sequence
  Synthetic oligonucleotide
caaccuuggcugagucuugagactg

SEQ ID NO: 103 - DNA, 25 bp, Artificial Sequence
  Synthetic oligonucleotide
ggcugagucuugagacugaaagatt

SEQ ID NO: 104 - DNA, 25 bp, Artificial Sequence
  Synthetic oligonucleotide
gucuugagacugaaagauuuagcca

SEQ ID NO: 105 - DNA, 25 bp, Artificial Sequence
  Synthetic oligonucleotide
gacugaaagauuuagccauaaugta

SEQ ID NO: 106 - DNA, 25 bp, Artificial Sequence
  Synthetic oligonucleotide
aaagauuuagccauaauguaaactg

SEQ ID NO: 107 - DNA, 25 bp, Artificial Sequence
  Synthetic oligonucleotide
gccauaauguaaacugccucaaatt

SEQ ID NO: 108 - DNA, 25 bp, Artificial Sequence
  Synthetic oligonucleotide
guaaacugccucaaauuggacuutg

SEQ ID NO: 109 - DNA, 25 bp, Artificial Sequence
  Synthetic oligonucleotide
ugccucaaauuggacuuugggcata

SEQ ID NO: 110 - DNA, 25 bp, Artificial Sequence
  Synthetic oligonucleotide
caaauuggacuuugggcauaaaaga

SEQ ID NO: 111 - DNA, 25 bp, Artificial Sequence
  Synthetic oligonucleotide
gacuuugggcauaaaagaacuuutt

SEQ ID NO: 112 - DNA, 25 bp, Artificial Sequence
  Synthetic oligonucleotide
ggcauaaaagaacuuuuuuaugctt

SEQ ID NO: 113 - DNA, 25 bp, Artificial Sequence
  Synthetic oligonucleotide
aaaagaacuuuuuuaugcuuaccat

SEQ ID NO: 114 - DNA, 25 bp, Artificial Sequence
  Synthetic oligonucleotide
aacuuuuuuaugcuuaccaucuutt

SEQ ID NO: 115 - DNA, 25 bp, Artificial Sequence
  Synthetic oligonucleotide
uuuaugcuuaccaucuuuuuuuutt

SEQ ID NO: 116 - DNA, 25 bp, Artificial Sequence
  Synthetic oligonucleotide
gcuuaccaucuuuuuuuuuucuuta

SEQ ID NO: 117 - DNA, 25 bp, Artificial Sequence
  Synthetic oligonucleotide
ccaucuuuuuuuuuucuuuaacaga

SEQ ID NO: 118 - DNA, 25 bp, Artificial Sequence
  Synthetic oligonucleotide
uuuuuuuuucuuuaacagauuugta

SEQ ID NO: 119 - DNA, 25 bp, Artificial Sequence
  Synthetic oligonucleotide
cuuuaacagauuuguauuuaagaat

SEQ ID NO: 120 - DNA, 25 bp, Artificial Sequence
  Synthetic oligonucleotide
cagauuuguauuuaagaauuguutt

SEQ ID NO: 121 - DNA, 25 bp, Artificial Sequence
  Synthetic oligonucleotide
uauuuaagaauuguuuuuaaaaaat

SEQ ID NO: 122 - DNA, 25 bp, Artificial Sequence
  Synthetic oligonucleotide
gaauuguuuuuaaaaaauuuuaaga

SEQ ID NO: 123 - DNA, 25 bp, Artificial Sequence
  Synthetic oligonucleotide
aauguuucucuguaaauauugccat

SEQ ID NO: 124 - DNA, 25 bp, Artificial Sequence
  Synthetic oligonucleotide
cuguaaauauugccauuaaauguaa

SEQ ID NO: 125 - DNA, 25 bp, Artificial Sequence
  Synthetic oligonucleotide
aauauugccauuaaauguaaauaac

SEQ ID NO: 126 - DNA, 25 bp, Artificial Sequence
  Synthetic oligonucleotide
ccauuaaauguaaauaacuuuaata

SEQ ID NO: 127 - DNA, 25 bp, Artificial Sequence
  Synthetic oligonucleotide
uuaauaaaacguuuauagcaguuac

SEQ ID NO: 128 - DNA, 25 bp, Artificial Sequence
  Synthetic oligonucleotide
cagaauuucaauccuaguauauagt

SEQ ID NO: 129 - DNA, 25 bp, Artificial Sequence
  Synthetic oligonucleotide
cuaguauuauagguacuauaaaccc

SEQ ID NO: 130 - DNA, 25 bp, Artificial Sequence
  Synthetic oligonucleotide
uauagguacuauaaacccuaauutt

SEQ ID NO: 131 - DNA, 25 bp, Artificial Sequence
  Synthetic oligonucleotide
acuauaaacccuaauuuuuuuuatt

SEQ ID NO: 132 - DNA, 25 bp, Artificial Sequence
  Synthetic oligonucleotide
cccuaauuuuuuuuauuuaaguaca

SEQ ID NO: 133 - DNA, 25 bp, Artificial Sequence
  Synthetic oligonucleotide
auuuuuuuuauuuaaguacauuutg

SEQ ID NO: 134 - DNA, 25 bp, Artificial Sequence
  Synthetic oligonucleotide
uauuuaaguacauuuugcuuuuuaa

SEQ ID NO: 135 - DNA, 25 bp, Artificial Sequence
  Synthetic oligonucleotide
aaguacauuuugcuuuuuaaagutg

SEQ ID NO: 136 - DNA, 25 bp, Artificial Sequence
  Synthetic oligonucleotide
auuuugcuuuuuaaaguugauuutt

SEQ ID NO: 137 - DNA, 25 bp, Artificial Sequence
  Synthetic oligonucleotide
cuuuuuaaaguugauuuuuuucuat

SEQ ID NO: 138 - DNA, 25 bp, Artificial Sequence
  Synthetic oligonucleotide
uauuguuuuuagaaaaaauaaaata

SEQ ID NO: 139 - DNA, 25 bp, Artificial Sequence
  Synthetic oligonucleotide
uuuuuagaaaaaauaaaauaacugg

SEQ ID NO: 140 - DNA, 25 bp, Artificial Sequence
  Synthetic oligonucleotide
aaaaauaaaauaacuggcaaauata

SEQ ID NO: 141 - DNA, 25 bp, Artificial Sequence
  Synthetic oligonucleotide
aauaacuggcaaauauaucauugag

SEQ ID NO: 142 - DNA, 25 bp, Artificial Sequence
  Synthetic oligonucleotide
caaauauaucauugagccaaauctt

SEQ ID NO: 143 - DNA, 25 bp, Artificial Sequence
  Synthetic oligonucleotide
aucauugagccaaaucuuaaaaaaa

SEQ ID NO: 144 - DNA, 25 bp, Artificial Sequence
  Synthetic oligonucleotide
gagccaaaucuuaaaaaaaaaaaaa

SEQ ID NO: 145 - DNA, 25 bp, Artificial Sequence
  Synthetic oligonucleotide
acucgcuguaguaauuccagcgaga

SEQ ID NO: 146 - DNA, 25 bp, Artificial Sequence
  Synthetic oligonucleotide
cucgcuguaguaauuccagcgagag

SEQ ID NO: 147 - DNA, 25 bp, Artificial Sequence
  Synthetic oligonucleotide
ucgcuguaguaauuccagcgagagg

SEQ ID NO: 148 - DNA, 25 bp, Artificial Sequence
  Synthetic oligonucleotide
cgcuguaguaauuccagcgagaggc

SEQ ID NO: 149 - DNA, 25 bp, Artificial Sequence
  Synthetic oligonucleotide
gcuguaguaauuccagcgagaggca

SEQ ID NO: 150 - DNA, 25 bp, Artificial Sequence
  Synthetic oligonucleotide
cuguaguaauuccagcgagaggcag

SEQ ID NO: 151 - DNA, 25 bp, Artificial Sequence
  Synthetic oligonucleotide
uguaguaauuccagcgagaggcaga

SEQ ID NO: 152 - DNA, 25 bp, Artificial Sequence
  Synthetic oligonucleotide
guaguaauuccagcgagaggcagag

SEQ ID NO: 153 - DNA, 25 bp, Artificial Sequence
  Synthetic oligonucleotide
cuucaccaacaggaacuaugacctc

SEQ ID NO: 154 - DNA, 25 bp, Artificial Sequence
  Synthetic oligonucleotide
uucaccaacaggaacuaugaccucg

SEQ ID NO: 155 - DNA, 25 bp, Artificial Sequence
  Synthetic oligonucleotide
ucaccaacaggaacuaugaccucga

SEQ ID NO: 156 - DNA, 25 bp, Artificial Sequence
  Synthetic oligonucleotide
caccaacaggaacuaugaccucgac

SEQ ID NO: 157 - DNA, 25 bp, Artificial Sequence
  Synthetic oligonucleotide
accaacaggaacuaugaccucgact

SEQ ID NO: 158 - DNA, 25 bp, Artificial Sequence
  Synthetic oligonucleotide
ccaacaggaacuaugaccucgacta

SEQ ID NO: 159 - DNA, 25 bp, Artificial Sequence
  Synthetic oligonucleotide
caacaggaacuaugaccucgacuac

SEQ ID NO: 160 - DNA, 25 bp, Artificial Sequence
  Synthetic oligonucleotide
aacaggaacuaugaccucgacuacg

SEQ ID NO: 161 - DNA, 25 bp, Artificial Sequence
  Synthetic oligonucleotide
acaggaacuaugaccucgacuacga

SEQ ID NO: 162 - DNA, 25 bp, Artificial Sequence
  Synthetic oligonucleotide
caggaacuaugaccucgacuacgac

SEQ ID NO: 163 - DNA, 25 bp, Artificial Sequence
  Synthetic oligonucleotide
aggaacuaugaccucgacuacgact

SEQ ID NO: 164 - DNA, 25 bp, Artificial Sequence
  Synthetic oligonucleotide
ggaacuaugaccucgacuacgactc

SEQ ID NO: 165 - DNA, 25 bp, Artificial Sequence
  Synthetic oligonucleotide
gaacuaugaccucgacuacgacucg

SEQ ID NO: 166 - DNA, 25 bp, Artificial Sequence
  Synthetic oligonucleotide
aacuaugaccucgacuacgacucgg

SEQ ID NO: 167 - DNA, 25 bp, Artificial Sequence
  Synthetic oligonucleotide
acuaugaccucgacuacgacucggt

SEQ ID NO: 168 - DNA, 25 bp, Artificial Sequence
  Synthetic oligonucleotide
cuaugaccucgacuacgacucggtg

SEQ ID NO: 169 - DNA, 25 bp, Artificial Sequence
  Synthetic oligonucleotide
uaugaccucgacuacgacucggugc

SEQ ID NO: 170 - DNA, 25 bp, Artificial Sequence
  Synthetic oligonucleotide
augaccucgacuacgacucggugca

SEQ ID NO: 171 - DNA, 25 bp, Artificial Sequence
  Synthetic oligonucleotide
gaggauaucuggaagaaauucgagc

SEQ ID NO: 172 - DNA, 25 bp, Artificial Sequence
  Synthetic oligonucleotide
aggauaucuggaagaaauucgagct

SEQ ID NO: 173 - DNA, 25 bp, Artificial Sequence
  Synthetic oligonucleotide
ggauaucuggaagaaauucgagctg

SEQ ID NO: 174 - DNA, 25 bp, Artificial Sequence
  Synthetic oligonucleotide
gauaucuggaagaaauucgagcugc

SEQ ID NO: 175 - DNA, 25 bp, Artificial Sequence
  Synthetic oligonucleotide
auaucuggaagaaauucgagcugct

SEQ ID NO: 176 - DNA, 25 bp, Artificial Sequence
  Synthetic oligonucleotide
uaucuggaagaaauucgagcugctg

SEQ ID NO: 177 - DNA, 25 bp, Artificial Sequence
  Synthetic oligonucleotide
aucuggaagaaauucgagcugcugc

SEQ ID NO: 178 - DNA, 25 bp, Artificial Sequence
  Synthetic oligonucleotide
ucuggaagaaauucgagcugcugcc

SEQ ID NO: 179 - DNA, 25 bp, Artificial Sequence
  Synthetic oligonucleotide
cuggaagaaauucgagcugcugccc

SEQ ID NO: 180 - DNA, 25 bp, Artificial Sequence
  Synthetic oligonucleotide
uggaagaaauucgagcugcugccca

SEQ ID NO: 181 - DNA, 25 bp, Artificial Sequence
  Synthetic oligonucleotide
ggaagaaauucgagcugcugcccac

SEQ ID NO: 182 - DNA, 25 bp, Artificial Sequence
  Synthetic oligonucleotide
agccgccgcuccgggcucugcucgc

SEQ ID NO: 183 - DNA, 25 bp, Artificial Sequence
  Synthetic oligonucleotide
gccgccgcuccgggcucugcucgcc

SEQ ID NO: 184 - DNA, 25 bp, Artificial Sequence
  Synthetic oligonucleotide
ccgccgcuccgggcucugcucgccc

SEQ ID NO: 185 - DNA, 25 bp, Artificial Sequence
  Synthetic oligonucleotide
cgccgcuccgggcucugcucgccct

SEQ ID NO: 186 - DNA, 25 bp, Artificial Sequence
  Synthetic oligonucleotide
gccgcuccgggcucugcucgccctc

SEQ ID NO: 187 - DNA, 25 bp, Artificial Sequence
  Synthetic oligonucleotide
ggaggagacauggugaaccagagtt

SEQ ID NO: 188 - DNA, 25 bp, Artificial Sequence
  Synthetic oligonucleotide
gaggagacauggugaaccagagutt

SEQ ID NO: 189 - DNA, 25 bp, Artificial Sequence
  Synthetic oligonucleotide
aggagacauggugaaccagaguutc

SEQ ID NO: 190 - DNA, 25 bp, Artificial Sequence
  Synthetic oligonucleotide
ggagacauggugaaccagaguuuca

SEQ ID NO: 191 - DNA, 25 bp, Artificial Sequence
  Synthetic oligonucleotide
gagacauggugaaccagaguuucat

SEQ ID NO: 192 - DNA, 25 bp, Artificial Sequence
  Synthetic oligonucleotide
gacgacgagaccuucaucaaaaaca

SEQ ID NO: 193 - DNA, 25 bp, Artificial Sequence
  Synthetic oligonucleotide
acgacgagaccuucaucaaaaacat

SEQ ID NO: 194 - DNA, 25 bp, Artificial Sequence
  Synthetic oligonucleotide
aacaucaucauccaggacuguaugt

SEQ ID NO: 195 - DNA, 25 bp, Artificial Sequence
  Synthetic oligonucleotide
acaucaucauccaggacuguaugtg

SEQ ID NO: 196 - DNA, 25 bp, Artificial Sequence
  Synthetic oligonucleotide
caucaucauccaggacuguaugugg

SEQ ID NO: 197 - DNA, 25 bp, Artificial Sequence
  Synthetic oligonucleotide
aucaucauccaggacuguaugugga

SEQ ID NO: 198 - DNA, 25 bp, Artificial Sequence
  Synthetic oligonucleotide
ucaucauccaggacuguauguggag

SEQ ID NO: 199 - DNA, 25 bp, Artificial Sequence
  Synthetic oligonucleotide
caucauccaggacuguauguggagc

SEQ ID NO: 200 - DNA, 25 bp, Artificial Sequence
  Synthetic oligonucleotide
aucauccaggacuguauguggagcg

SEQ ID NO: 201 - DNA, 25 bp, Artificial Sequence
  Synthetic oligonucleotide
ucauccaggacuguauguggagcgg

SEQ ID NO: 202 - DNA, 25 bp, Artificial Sequence
  Synthetic oligonucleotide
cauccaggacuguauguggagcggc

SEQ ID NO: 203 - DNA, 25 bp, Artificial Sequence
  Synthetic oligonucleotide
auccaggacuguauguggagcggct

SEQ ID NO: 204 - DNA, 25 bp, Artificial Sequence
  Synthetic oligonucleotide
uccaggacuguauguggagcggctt

SEQ ID NO: 205 - DNA, 25 bp, Artificial Sequence
  Synthetic oligonucleotide
ccaggacuguauguggagcggcutc

SEQ ID NO: 206 - DNA, 25 bp, Artificial Sequence
  Synthetic oligonucleotide
caggacuguauguggagcggcuuct

SEQ ID NO: 207 - DNA, 25 bp, Artificial Sequence
  Synthetic oligonucleotide
aggacuguauguggagcggcuuctc

SEQ ID NO: 208 - DNA, 25 bp, Artificial Sequence
  Synthetic oligonucleotide
gagaagcuggccuccuaccaggctg

SEQ ID NO: 209 - DNA, 25 bp, Artificial Sequence
  Synthetic oligonucleotide
agaagcuggccuccuaccaggcugc

SEQ ID NO: 210 - DNA, 25 bp, Artificial Sequence
  Synthetic oligonucleotide
gaagcuggccuccuaccaggcugcg

SEQ ID NO: 211 - DNA, 25 bp, Artificial Sequence
  Synthetic oligonucleotide
aagcuggccuccuaccaggcugcgc

SEQ ID NO: 212 - DNA, 25 bp, Artificial Sequence
  Synthetic oligonucleotide
agcuggccuccuaccaggcugcgcg

SEQ ID NO: 213 - DNA, 25 bp, Artificial Sequence
  Synthetic oligonucleotide
gcuggccuccuaccaggcugcgcgc

SEQ ID NO: 214 - DNA, 25 bp, Artificial Sequence
  Synthetic oligonucleotide
cuggccuccuaccaggcugcgcgca

SEQ ID NO: 215 - DNA, 25 bp, Artificial Sequence
  Synthetic oligonucleotide
uggccuccuaccaggcugcgcgcaa

SEQ ID NO: 216 - DNA, 25 bp, Artificial Sequence
  Synthetic oligonucleotide
ggccuccuaccaggcugcgcgcaaa

SEQ ID NO: 217 - DNA, 25 bp, Artificial Sequence
  Synthetic oligonucleotide
gccuccuaccaggcugcgcgcaaag

SEQ ID NO: 218 - DNA, 25 bp, Artificial Sequence
  Synthetic oligonucleotide
ccuccuaccaggcugcgcgcaaaga

SEQ ID NO: 219 - DNA, 25 bp, Artificial Sequence
  Synthetic oligonucleotide
cuccuaccaggcugcgcgcaaagac

SEQ ID NO: 220 - DNA, 25 bp, Artificial Sequence
  Synthetic oligonucleotide
uccuaccaggcugcgcgcaaagaca

SEQ ID NO: 221 - DNA, 25 bp, Artificial Sequence
  Synthetic oligonucleotide
ccuaccaggcugcgcgcaaagacag

SEQ ID NO: 222 - DNA, 25 bp, Artificial Sequence
  Synthetic oligonucleotide
cuaccaggcugcgcgcaaagacagc

SEQ ID NO: 223 - DNA, 25 bp, Artificial Sequence
  Synthetic oligonucleotide
uaccaggcugcgcgcaaagacagcg

SEQ ID NO: 224 - DNA, 25 bp, Artificial Sequence
  Synthetic oligonucleotide
accaggcugcgcgcaaagacagcgg

SEQ ID NO: 225 - DNA, 25 bp, Artificial Sequence
  Synthetic oligonucleotide
ccaggcugcgcgcaaagacagcggc

SEQ ID NO: 226 - DNA, 25 bp, Artificial Sequence
  Synthetic oligonucleotide
caggcugcgcgcaaagacagcggca

SEQ ID NO: 227 - DNA, 25 bp, Artificial Sequence
  Synthetic oligonucleotide
aggcugcgcgcaaagacagcggcag

SEQ ID NO: 228 - DNA, 25 bp, Artificial Sequence
  Synthetic oligonucleotide
ggcugcgcgcaaagacagcggcagc

SEQ ID NO: 229 - DNA, 25 bp, Artificial Sequence
  Synthetic oligonucleotide
cacagcgucugcuccaccuccagct

SEQ ID NO: 230 - DNA, 25 bp, Artificial Sequence
  Synthetic oligonucleotide
acagcgucugcuccaccuccagctt

SEQ ID NO: 231 - DNA, 25 bp, Artificial Sequence
  Synthetic oligonucleotide
cagcgucugcuccaccuccagcutg

SEQ ID NO: 232 - DNA, 25 bp, Artificial Sequence
  Synthetic oligonucleotide
agcgucugcuccaccuccagcuugt

SEQ ID NO: 233 - DNA, 25 bp, Artificial Sequence
  Synthetic oligonucleotide
gcgucugcuccaccuccagcuugta

SEQ ID NO: 234 - DNA, 25 bp, Artificial Sequence
  Synthetic oligonucleotide
cgucugcuccaccuccagcuuguac

SEQ ID NO: 235 - DNA, 25 bp, Artificial Sequence
  Synthetic oligonucleotide
cucaacgacagcagcucgcccaagt

SEQ ID NO: 236 - DNA, 25 bp, Artificial Sequence
  Synthetic oligonucleotide
ucaacgacagcagcucgcccaagtc

SEQ ID NO: 237 - DNA, 25 bp, Artificial Sequence
  Synthetic oligonucleotide
caacgacagcagcucgcccaagucc

SEQ ID NO: 238 - DNA, 25 bp, Artificial Sequence
  Synthetic oligonucleotide
aacgacagcagcucgcccaagucct

SEQ ID NO: 239 - DNA, 25 bp, Artificial Sequence
  Synthetic oligonucleotide
acgacagcagcucgcccaagucctg

SEQ ID NO: 240 - DNA, 25 bp, Artificial Sequence
  Synthetic oligonucleotide
caugaggagacaccgcccaccacca

SEQ ID NO: 241 - DNA, 25 bp, Artificial Sequence
  Synthetic oligonucleotide
augaggagacaccgcccaccaccag

SEQ ID NO: 242 - DNA, 25 bp, Artificial Sequence
  Synthetic oligonucleotide
ugaggagacaccgcccaccaccagc

SEQ ID NO: 243 - DNA, 25 bp, Artificial Sequence
  Synthetic oligonucleotide
gaggagacaccgcccaccaccagca

SEQ ID NO: 244 - DNA, 25 bp, Artificial Sequence
  Synthetic oligonucleotide
aggagacaccgcccaccaccagcag

SEQ ID NO: 245 - DNA, 25 bp, Artificial Sequence
  Synthetic oligonucleotide
ggagacaccgcccaccaccagcagc

SEQ ID NO: 246 - DNA, 25 bp, Artificial Sequence
  Synthetic oligonucleotide
gagacaccgcccaccaccagcagcg

SEQ ID NO: 247 - DNA, 25 bp, Artificial Sequence
  Synthetic oligonucleotide
agacaccgcccaccaccagcagcga

SEQ ID NO: 248 - DNA, 25 bp, Artificial Sequence
  Synthetic oligonucleotide
gacaccgcccaccaccagcagcgac

SEQ ID NO: 249 - DNA, 25 bp, Artificial Sequence
  Synthetic oligonucleotide
acaccgcccaccaccagcagcgact

SEQ ID NO: 250 - DNA, 25 bp, Artificial Sequence
  Synthetic oligonucleotide
caccgcccaccaccagcagcgactc

SEQ ID NO: 251 - DNA, 25 bp, Artificial Sequence
  Synthetic oligonucleotide
accgcccaccaccagcagcgacuct

SEQ ID NO: 252 - DNA, 25 bp, Artificial Sequence
  Synthetic oligonucleotide
ccgcccaccaccagcagcgacuctg

SEQ ID NO: 253 - DNA, 25 bp, Artificial Sequence
  Synthetic oligonucleotide
cgcccaccaccagcagcgacucuga

SEQ ID NO: 254 - DNA, 25 bp, Artificial Sequence
  Synthetic oligonucleotide
gcccaccaccagcagcgacucugag

SEQ ID NO: 255 - DNA, 25 bp, Artificial Sequence
  Synthetic oligonucleotide
cccaccaccagcagcgacucugagg

SEQ ID NO: 256 - DNA, 25 bp, Artificial Sequence
  Synthetic oligonucleotide
ccaccaccagcagcgacucugagga

SEQ ID NO: 257 - DNA, 25 bp, Artificial Sequence
  Synthetic oligonucleotide
caccaccagcagcgacucugaggag

SEQ ID NO: 258 - DNA, 25 bp, Artificial Sequence
  Synthetic oligonucleotide
accaccagcagcgacucugaggagg

SEQ ID NO: 259 - DNA, 25 bp, Artificial Sequence
  Synthetic oligonucleotide
ccaccagcagcgacucugaggagga

SEQ ID NO: 260 - DNA, 25 bp, Artificial Sequence
  Synthetic oligonucleotide
caagaagaugaggaagaaaucgatg

SEQ ID NO: 261 - DNA, 25 bp, Artificial Sequence
  Synthetic oligonucleotide
aagaagaugaggaagaaaucgaugt

SEQ ID NO: 262 - DNA, 25 bp, Artificial Sequence
  Synthetic oligonucleotide
gaggccacagcaaaccuccucacag

SEQ ID NO: 263 - DNA, 25 bp, Artificial Sequence
  Synthetic oligonucleotide
cacagcccacugguccucaagaggt

SEQ ID NO: 264 - DNA, 25 bp, Artificial Sequence
  Synthetic oligonucleotide
acagcccacugguccucaagaggtg

SEQ ID NO: 265 - DNA, 25 bp, Artificial Sequence
  Synthetic oligonucleotide
cagcccacugguccucaagaggugc

SEQ ID NO: 266 - DNA, 25 bp, Artificial Sequence
  Synthetic oligonucleotide
agcccacugguccucaagaggugcc

SEQ ID NO: 267 - DNA, 25 bp, Artificial Sequence
  Synthetic oligonucleotide
gcccacugguccucaagaggugcca

SEQ ID NO: 268 - DNA, 25 bp, Artificial Sequence
  Synthetic oligonucleotide
cccacugguccucaagaggugccac

SEQ ID NO: 269 - DNA, 25 bp, Artificial Sequence
  Synthetic oligonucleotide
ccacugguccucaagaggugccacg

SEQ ID NO: 270 - DNA, 25 bp, Artificial Sequence
  Synthetic oligonucleotide
cacugguccucaagaggugccacgt

SEQ ID NO: 271 - DNA, 25 bp, Artificial Sequence
  Synthetic oligonucleotide
acugguccucaagaggugccacgtc

SEQ ID NO: 272 - DNA, 25 bp, Artificial Sequence
  Synthetic oligonucleotide
cugguccucaagaggugccacguct

SEQ ID NO: 273 - DNA, 25 bp, Artificial Sequence
  Synthetic oligonucleotide
ugguccucaagaggugccacguctc

SEQ ID NO: 274 - DNA, 25 bp, Artificial Sequence
  Synthetic oligonucleotide
gguccucaagaggugccacgucucc

SEQ ID NO: 275 - DNA, 25 bp, Artificial Sequence
  Synthetic oligonucleotide
guccucaagaggugccacgucucca

SEQ ID NO: 276 - DNA, 25 bp, Artificial Sequence
  Synthetic oligonucleotide
uccucaagaggugccacgucuccac

SEQ ID NO: 277 - DNA, 25 bp, Artificial Sequence
  Synthetic oligonucleotide
ccucaagaggugccacgucuccaca

SEQ ID NO: 278 - DNA, 25 bp, Artificial Sequence
  Synthetic oligonucleotide
cucaagaggugccacgucuccacac

SEQ ID NO: 279 - DNA, 25 bp, Artificial Sequence
  Synthetic oligonucleotide
agcuuuuuugcccugcgugaccaga

SEQ ID NO: 280 - DNA, 25 bp, Artificial Sequence
  Synthetic oligonucleotide
gcuuuuuugcccugcgugaccagat

SEQ ID NO: 281 - DNA, 25 bp, Artificial Sequence
  Synthetic oligonucleotide
cuuuuuugcccugcgugaccagatc

SEQ ID NO: 282 - DNA, 25 bp, Artificial Sequence
  Synthetic oligonucleotide
uuuuuugcccugcgugaccagaucc

SEQ ID NO: 283 - DNA, 25 bp, Artificial Sequence
  Synthetic oligonucleotide
uuuuugcccugcgugaccagauccc

SEQ ID NO: 284 - DNA, 25 bp, Artificial Sequence
  Synthetic oligonucleotide
uuuugcccugcgugaccagaucccg

SEQ ID NO: 285 - DNA, 25 bp, Artificial Sequence
  Synthetic oligonucleotide
uuugcccugcgugaccagaucccgg

SEQ ID NO: 286 - DNA, 25 bp, Artificial Sequence
  Synthetic oligonucleotide
uugcccugcgugaccagaucccgga

SEQ ID NO: 287 - DNA, 25 bp, Artificial Sequence
  Synthetic oligonucleotide
ugcccugcgugaccagaucccggag

SEQ ID NO: 288 - DNA, 25 bp, Artificial Sequence
  Synthetic oligonucleotide
gcccugcgugaccagaucccggagt

SEQ ID NO: 289 - DNA, 25 bp, Artificial Sequence
  Synthetic oligonucleotide
cccugcgugaccagaucccggagtt

SEQ ID NO: 290 - DNA, 25 bp, Artificial Sequence
  Synthetic oligonucleotide
ggaaacgacgagaacaguugaaaca

SEQ ID NO: 291 - DNA, 25 bp, Artificial Sequence
  Synthetic oligonucleotide
gaaacgacgagaacaguugaaacac

SEQ ID NO: 292 - DNA, 25 bp, Artificial Sequence
  Synthetic oligonucleotide
uuuaacagauuuguauuuaagaatt

SEQ ID NO: 293 - DNA, 25 bp, Artificial Sequence
  Synthetic oligonucleotide
uuaacagauuuguauuuaagaautg

SEQ ID NO: 294 - DNA, 25 bp, Artificial Sequence
  Synthetic oligonucleotide
aaauguaaauaacuuuaauaaaacg

SEQ ID NO: 295 - DNA, 25 bp, Artificial Sequence
  Synthetic oligonucleotide
aauguaaauaacuuuaauaaaacgt

SEQ ID NO: 296 - DNA, 25 bp, Artificial Sequence
  Synthetic oligonucleotide
auguaaauaacuuuaauaaaacgtt

SEQ ID NO: 297 - DNA, 25 bp, Artificial Sequence
  Synthetic oligonucleotide
uguaaauaacuuuaauaaaacgutt

SEQ ID NO: 298 - DNA, 25 bp, Artificial Sequence
  Synthetic oligonucleotide
guaaauaacuuuaauaaaacguuta

SEQ ID NO: 299 - DNA, 25 bp, Artificial Sequence
  Synthetic oligonucleotide
uaaauaacuuuaauaaaacguuuat

SEQ ID NO: 300 - DNA, 25 bp, Artificial Sequence
  Synthetic oligonucleotide
aaauaacuuuaauaaaacguuuata

SEQ ID NO: 301 - DNA, 25 bp, Artificial Sequence
  Synthetic oligonucleotide
aauaacuuuaauaaaacguuuauag

SEQ ID NO: 302 - DNA, 25 bp, Artificial Sequence
  Synthetic oligonucleotide
auaacuuuaauaaaacguuuauagc

SEQ ID NO: 303 - DNA, 25 bp, Artificial Sequence
  Synthetic oligonucleotide
uaacuuuaauaaaacguuuauagca

SEQ ID NO: 304 - DNA, 25 bp, Artificial Sequence
  Synthetic oligonucleotide
aacuuuaauaaaacguuuauagcag

SEQ ID NO: 305 - DNA, 25 bp, Artificial Sequence
  Synthetic oligonucleotide
acuuuaauaaaacguuuauagcagt

SEQ ID NO: 306 - DNA, 25 bp, Artificial Sequence
  Synthetic oligonucleotide
cuuuaauaaaacguuuauagcagtt

SEQ ID NO: 307 - DNA, 25 bp, Artificial Sequence
  Synthetic oligonucleotide
uuuuuaaaguugauuuuuuucuatt

SEQ ID NO: 308 - DNA, 25 bp, Artificial Sequence
  Synthetic oligonucleotide
uuuuaaaguugauuuuuuucuautg

SEQ ID NO: 309 - DNA, 25 bp, Artificial Sequence
  Synthetic oligonucleotide
uuuaaaguugauuuuuuucuauugt

SEQ ID NO: 310 - DNA, 25 bp, Artificial Sequence
  Synthetic oligonucleotide
uuaaaguugauuuuuuucuauugtt

SEQ ID NO: 311 - DNA, 25 bp, Artificial Sequence
  Synthetic oligonucleotide
uaaaguugauuuuuuucuauugutt

SEQ ID NO: 312 - DNA, 25 bp, Artificial Sequence
  Synthetic oligonucleotide
aaaguugauuuuuuucuauuguutt

SEQ ID NO: 313 - DNA, 25 bp, Artificial Sequence
  Synthetic oligonucleotide
aaguugauuuuuuucuauuguuutt

SEQ ID NO: 314 - DNA, 25 bp, Artificial Sequence
  Synthetic oligonucleotide
aguugauuuuuuucuauuguuuuta

SEQ ID NO: 315 - DNA, 25 bp, Artificial Sequence
  Synthetic oligonucleotide
guugauuuuuuucuauuguuuuuag

SEQ ID NO: 316 - DNA, 25 bp, Artificial Sequence
  Synthetic oligonucleotide
uugauuuuuuucuauuguuuuuaga

SEQ ID NO: 317 - DNA, 25 bp, Artificial Sequence
  Synthetic oligonucleotide
ugauuuuuuucuauuguuuuuagaa

SEQ ID NO: 318 - DNA, 25 bp, Artificial Sequence
  Synthetic oligonucleotide
gauuuuuuucuauuguuuuuagaaa

SEQ ID NO: 319 - DNA, 25 bp, Artificial Sequence
  Synthetic oligonucleotide
auuuuuuucuauuguuuuuagaaaa

SEQ ID NO: 320 - DNA, 25 bp, Artificial Sequence
  Synthetic oligonucleotide
uuuuuuucuauuguuuuuagaaaaa

SEQ ID NO: 321 - DNA, 25 bp, Artificial Sequence
  Synthetic oligonucleotide
uuuuuucuauuguuuuuagaaaaaa

SEQ ID NO: 322 - DNA, 25 bp, Artificial Sequence
  Synthetic oligonucleotide
uuuuucuauuguuuuuagaaaaaat

SEQ ID NO: 323 - DNA, 25 bp, Artificial Sequence
  Synthetic oligonucleotide
uuuucuauuguuuuuagaaaaaata

SEQ ID NO: 324 - DNA, 25 bp, Artificial Sequence
  Synthetic oligonucleotide
uuucuauuguuuuuagaaaaaauaa

SEQ ID NO: 325 - DNA, 25 bp, Artificial Sequence
  Synthetic oligonucleotide
uucuauuguuuuuagaaaaaauaaa

SEQ ID NO: 326 - DNA, 25 bp, Artificial Sequence
  Synthetic oligonucleotide
ucuauuguuuuuagaaaaaauaaaa

SEQ ID NO: 327 - DNA, 25 bp, Artificial Sequence
  Synthetic oligonucleotide
cuauuguuuuuagaaaaaauaaaat

SEQ ID NO: 328 - RNA, 27 nt, Artificial Sequence
  Synthetic oligonucleotide
ccucugagaagcccugcccuucucgag

SEQ ID NO: 329 - RNA, 27 nt, Artificial Sequence
  Synthetic oligonucleotide
auuacuacagcgaguuagauaaagccc

SEQ ID NO: 330 - RNA, 27 nt, Artificial Sequence
  Synthetic oligonucleotide
caaaguuucguggaugcggcaaggguu

SEQ ID NO: 331 - RNA, 27 nt, Artificial Sequence
  Synthetic oligonucleotide
augggcaaaguuucguggaugcggcaa

SEQ ID NO: 332 - RNA, 27 nt, Artificial Sequence
  Synthetic oligonucleotide
gcugcuaugggcaaaguuucguggaug

SEQ ID NO: 333 - RNA, 27 nt, Artificial Sequence
  Synthetic oligonucleotide
guaaguuccagugcaaagugcccgccc

SEQ ID NO: 334 - RNA, 27 nt, Artificial Sequence
  Synthetic oligonucleotide
gguguuguaaguuccagugcaaagugc

SEQ ID NO: 335 - RNA, 27 nt, Artificial Sequence
  Synthetic oligonucleotide
cuugcucggguguuguaaguuccagug

SEQ ID NO: 336 - RNA, 27 nt, Artificial Sequence
  Synthetic oligonucleotide
aaaaauccagcgucuaagcagcugcaa

SEQ ID NO: 337 - RNA, 27 nt, Artificial Sequence
  Synthetic oligonucleotide
cccgaaaaaaauccagcgucuaagcag

SEQ ID NO: 338 - RNA, 27 nt, Artificial Sequence
  Synthetic oligonucleotide
uccacuacccgaaaaaaauccagcguc

SEQ ID NO: 339 - RNA, 27 nt, Artificial Sequence
  Synthetic oligonucleotide
gguuuuccacuacccgaaaaaaaucca

SEQ ID NO: 340 - RNA, 27 nt, Artificial Sequence
  Synthetic oligonucleotide
gaggcugcugguuuuccacuacccgaa

SEQ ID NO: 341 - RNA, 27 nt, Artificial Sequence
  Synthetic oligonucleotide
uccuguuggugaagcuaacguugaggg

SEQ ID NO: 342 - RNA, 27 nt, Artificial Sequence
  Synthetic oligonucleotide
cauaguuccuguuggugaagcuaacgu

SEQ ID NO: 343 - RNA, 27 nt, Artificial Sequence
  Synthetic oligonucleotide
aguagaaauacggcugcaccgagucgu

SEQ ID NO: 344 - RNA, 27 nt, Artificial Sequence
  Synthetic oligonucleotide
cucgucgcaguagaaauacggcugcac

SEQ ID NO: 345 - RNA, 27 nt, Artificial Sequence
  Synthetic oligonucleotide
gcugcugcugguagaaguucuccuccu

SEQ ID NO: 346 - RNA, 27 nt, Artificial Sequence
  Synthetic oligonucleotide
ucgaauuucuuccagauauccucgcug

SEQ ID NO: 347 - RNA, 27 nt, Artificial Sequence
  Synthetic oligonucleotide
aagggagaagggugugaccgcaacgua

SEQ ID NO: 348 - RNA, 27 nt, Artificial Sequence
  Synthetic oligonucleotide
cagaugaaacucugguucaccaugucu

SEQ ID NO: 349 - RNA, 27 nt, Artificial Sequence
  Synthetic oligonucleotide
uuuugaugaaggucucgucguccgggu

SEQ ID NO: 350 - RNA, 27 nt, Artificial Sequence
  Synthetic oligonucleotide
ugaugauguuuuugaugaaggucucgu

SEQ ID NO: 351 - RNA, 27 nt, Artificial Sequence
  Synthetic oligonucleotide
uacaguccuggaugaugauguuuuuga

SEQ ID NO: 352 - RNA, 27 nt, Artificial Sequence
  Synthetic oligonucleotide
cgagaagccgcuccacauacaguccug

SEQ ID NO: 353 - RNA, 27 nt, Artificial Sequence
  Synthetic oligonucleotide
cagguacaagcuggagguggagcagac

SEQ ID NO: 354 - RNA, 27 nt, Artificial Sequence
  Synthetic oligonucleotide
gauccugcagguacaagcuggaggugg

SEQ ID NO: 355 - RNA, 27 nt, Artificial Sequence
  Synthetic oligonucleotide
gcucagauccugcagguacaagcugga

SEQ ID NO: 356 - RNA, 27 nt, Artificial Sequence
  Synthetic oligonucleotide
uggagucuugcgaggcgcaggacuugg

SEQ ID NO: 357 - RNA, 27 nt, Artificial Sequence
  Synthetic oligonucleotide
ucuuguuccuccucagagucgcugcug

SEQ ID NO: 358 - RNA, 27 nt, Artificial Sequence
  Synthetic oligonucleotide
ucaucuucuuguuccuccucagagucg

SEQ ID NO: 359 - RNA, 27 nt, Artificial Sequence
  Synthetic oligonucleotide
cuuccucaucuucuuguuccuccucag

SEQ ID NO: 360 - RNA, 27 nt, Artificial Sequence
  Synthetic oligonucleotide
ucgauuucuuccucaucuucuuguucc

SEQ ID NO: 361 - RNA, 27 nt, Artificial Sequence
  Synthetic oligonucleotide
acaacaucgauuucuuccucaucuucu

SEQ ID NO: 362 - RNA, 27 nt, Artificial Sequence
  Synthetic oligonucleotide
acagaaacaacaucgauuucuuccuca

SEQ ID NO: 363 - RNA, 27 nt, Artificial Sequence
  Synthetic oligonucleotide
uuuuccacagaaacaacaucgauuucu

SEQ ID NO: 364 - RNA, 27 nt, Artificial Sequence
  Synthetic oligonucleotide
ugccucuuuuccacagaaacaacaucg

SEQ ID NO: 365 - RNA, 27 nt, Artificial Sequence
  Synthetic oligonucleotide
ugaccuuuugccaggagccugccucuu

SEQ ID NO: 366 - RNA, 27 nt, Artificial Sequence
  Synthetic oligonucleotide
gacucugaccuuuugccaggagccugc

SEQ ID NO: 367 - RNA, 27 nt, Artificial Sequence
  Synthetic oligonucleotide
auccagacucugaccuuuugccaggag

SEQ ID NO: 368 - RNA, 27 nt, Artificial Sequence
  Synthetic oligonucleotide
aggugauccagacucugaccuuuugcc

SEQ ID NO: 369 - RNA, 27 nt, Artificial Sequence
  Synthetic oligonucleotide
gcagaaggugauccagacucugaccuu

SEQ ID NO: 370 - RNA, 27 nt, Artificial Sequence
  Synthetic oligonucleotide
accagugggcugugaggagguuugcug

SEQ ID NO: 371 - RNA, 27 nt, Artificial Sequence
  Synthetic oligonucleotide
ucuugaggaccagugggcugugaggag

SEQ ID NO: 372 - RNA, 27 nt, Artificial Sequence
  Synthetic oligonucleotide
caggauaguccuuccgaguggagggag

SEQ ID NO: 373 - RNA, 27 nt, Artificial Sequence
  Synthetic oligonucleotide
uuggcagcaggauaguccuuccgagug

SEQ ID NO: 374 - RNA, 27 nt, Artificial Sequence
  Synthetic oligonucleotide
aacuugacccucuuggcagcaggauag

SEQ ID NO: 375 - RNA, 27 nt, Artificial Sequence
  Synthetic oligonucleotide
uguccaacuugacccucuuggcagcag

SEQ ID NO: 376 - RNA, 27 nt, Artificial Sequence
  Synthetic oligonucleotide
gacacuguccaacuugacccucuuggc

SEQ ID NO: 377 - RNA, 27 nt, Artificial Sequence
  Synthetic oligonucleotide
acucugacacuguccaacuugacccuc

SEQ ID NO: 378 - RNA, 27 nt, Artificial Sequence
  Synthetic oligonucleotide
ucaggacucugacacuguccaacuuga

SEQ ID NO: 379 - RNA, 27 nt, Artificial Sequence
  Synthetic oligonucleotide
cugucucaggacucugacacuguccaa

SEQ ID NO: 380 - RNA, 27 nt, Artificial Sequence
  Synthetic oligonucleotide
guugcugaucugucucaggacucugac

SEQ ID NO: 381 - RNA, 27 nt, Artificial Sequence
  Synthetic oligonucleotide
uuuucgguuguugcugaucugucucag

SEQ ID NO: 382 - RNA, 27 nt, Artificial Sequence
  Synthetic oligonucleotide
ggugcauuuucgguuguugcugaucug

SEQ ID NO: 383 - RNA, 27 nt, Artificial Sequence
  Synthetic oligonucleotide
uugacauucuccucgguguccgaggac

SEQ ID NO: 384 - RNA, 27 nt, Artificial Sequence
  Synthetic oligonucleotide
gccucuugacauucuccucgguguccg

SEQ ID NO: 385 - RNA, 27 nt, Artificial Sequence
  Synthetic oligonucleotide
uccguuuuagcucguuccuccucuggc

SEQ ID NO: 386 - RNA, 27 nt, Artificial Sequence
  Synthetic oligonucleotide
aaaagcuccguuuuagcucguuccucc

SEQ ID NO: 387 - RNA, 27 nt, Artificial Sequence
  Synthetic oligonucleotide
ggcaaaaaagcuccguuuuagcucguu

SEQ ID NO: 388 - RNA, 27 nt, Artificial Sequence
  Synthetic oligonucleotide
acgcagggcaaaaaagcuccguuuuag

SEQ ID NO: 389 - RNA, 27 nt, Artificial Sequence
  Synthetic oligonucleotide
uggucacgcagggcaaaaaagcuccgu

SEQ ID NO: 390 - RNA, 27 nt, Artificial Sequence
  Synthetic oligonucleotide
uguuuuccaacuccgggaucuggucac

SEQ ID NO: 391 - RNA, 27 nt, Artificial Sequence
  Synthetic oligonucleotide
uucauuguuuuccaacuccgggaucug

SEQ ID NO: 392 - RNA, 27 nt, Artificial Sequence
  Synthetic oligonucleotide
gccuuuucauuguuuuccaacuccggg

SEQ ID NO: 393 - RNA, 27 nt, Artificial Sequence
  Synthetic oligonucleotide
guggcuuuuuuaaggauaacuaccuug

SEQ ID NO: 394 - RNA, 27 nt, Artificial Sequence
  Synthetic oligonucleotide
augcuguggcuuuuuuaaggauaacua

SEQ ID NO: 395 - RNA, 27 nt, Artificial Sequence
  Synthetic oligonucleotide
gauguaugcuguggcuuuuuuaaggau

SEQ ID NO: 396 - RNA, 27 nt, Artificial Sequence
  Synthetic oligonucleotide
gacaggauguaugcuguggcuuuuuua

SEQ ID NO: 397 - RNA, 27 nt, Artificial Sequence
  Synthetic oligonucleotide
ggacggacaggauguaugcuguggcuu

SEQ ID NO: 398 - RNA, 27 nt, Artificial Sequence
  Synthetic oligonucleotide
cugcuuggacggacaggauguaugcug

SEQ ID NO: 399 - RNA, 27 nt, Artificial Sequence
  Synthetic oligonucleotide
uugcuccucugcuuggacggacaggau

SEQ ID NO: 400 - RNA, 27 nt, Artificial Sequence
  Synthetic oligonucleotide
agcuuuugcuccucugcuuggacggac

SEQ ID NO: 401 - RNA, 27 nt, Artificial Sequence
  Synthetic oligonucleotide
cagaaaugagcuuuugcuccucugcuu

SEQ ID NO: 402 - RNA, 27 nt, Artificial Sequence
  Synthetic oligonucleotide
uccucuucagaaaugagcuuuugcucc

SEQ ID NO: 403 - RNA, 27 nt, Artificial Sequence
  Synthetic oligonucleotide
acaaguccucuucagaaaugagcuuuu

SEQ ID NO: 404 - RNA, 27 nt, Artificial Sequence
  Synthetic oligonucleotide
uccgcaacaaguccucuucagaaauga

SEQ ID NO: 405 - RNA, 27 nt, Artificial Sequence
  Synthetic oligonucleotide
gucguuuccgcaacaaguccucuucag

SEQ ID NO: 406 - RNA, 27 nt, Artificial Sequence
  Synthetic oligonucleotide
uucucgucguuuccgcaacaaguccuc

SEQ ID NO: 407 - RNA, 27 nt, Artificial Sequence
  Synthetic oligonucleotide
aacuguucucgucguuuccgcaacaag

SEQ ID NO: 408 - RNA, 27 nt, Artificial Sequence
  Synthetic oligonucleotide
guuucaacuguucucgucguuuccgca

SEQ ID NO: 409 - RNA, 27 nt, Artificial Sequence
  Synthetic oligonucleotide
aagaguuccguagcuguucaaguuugu

SEQ ID NO: 410 - RNA, 27 nt, Artificial Sequence
  Synthetic oligonucleotide
acgcacaagaguuccguagcuguucaa

SEQ ID NO: 411 - RNA, 27 nt, Artificial Sequence
  Synthetic oligonucleotide
uccuuacgcacaagaguuccguagcug

SEQ ID NO: 412 - RNA, 27 nt, Artificial Sequence
  Synthetic oligonucleotide
uuacuuuuccuuacgcacaagaguucc

SEQ ID NO: 413 - RNA, 27 nt, Artificial Sequence
  Synthetic oligonucleotide
uuuuccuuacuuuuccuuacgcacaag

SEQ ID NO: 414 - RNA, 27 nt, Artificial Sequence
  Synthetic oligonucleotide
aaucguuuuccuuacuuuuccuuacgc

SEQ ID NO: 415 - RNA, 27 nt, Artificial Sequence
  Synthetic oligonucleotide
uguuagaaggaaucguuuuccuuacuu

SEQ ID NO: 416 - RNA, 27 nt, Artificial Sequence
  Synthetic oligonucleotide
auuucuguuagaaggaaucguuuuccu

SEQ ID NO: 417 - RNA, 27 nt, Artificial Sequence
  Synthetic oligonucleotide
aggacauuucuguuagaaggaaucguu

SEQ ID NO: 418 - RNA, 27 nt, Artificial Sequence
  Synthetic oligonucleotide
uugcucaggacauuucuguuagaagga

SEQ ID NO: 419 - RNA, 27 nt, Artificial Sequence
  Synthetic oligonucleotide
uaggugauugcucaggacauuucuguu

SEQ ID NO: 420 - RNA, 27 nt, Artificial Sequence
  Synthetic oligonucleotide
acaaguucauaggugauugcucaggac

SEQ ID NO: 421 - RNA, 27 nt, Artificial Sequence
  Synthetic oligonucleotide
uuugaaacaaguucauaggugauugcu

SEQ ID NO: 422 - RNA, 27 nt, Artificial Sequence
  Synthetic oligonucleotide
caugcauuugaaacaaguucauaggug

SEQ ID NO: 423 - RNA, 27 nt, Artificial Sequence
  Synthetic oligonucleotide
uugaucaugcauuugaaacaaguucau

SEQ ID NO: 424 - RNA, 27 nt, Artificial Sequence
  Synthetic oligonucleotide
uugcauuugaucaugcauuugaaacaa

SEQ ID NO: 425 - RNA, 27 nt, Artificial Sequence
  Synthetic oligonucleotide
ugagguugcauuugaucaugcauuuga

SEQ ID NO: 426 - RNA, 27 nt, Artificial Sequence
  Synthetic oligonucleotide
caagguugugagguugcauuugaucau

SEQ ID NO: 427 - RNA, 27 nt, Artificial Sequence
  Synthetic oligonucleotide
ucagccaagguugugagguugcauuug

SEQ ID NO: 428 - RNA, 27 nt, Artificial Sequence
  Synthetic oligonucleotide
ucaagacucagccaagguugugagguu

SEQ ID NO: 429 - RNA, 27 nt, Artificial Sequence
  Synthetic oligonucleotide
cagucucaagacucagccaagguugug

SEQ ID NO: 430 - RNA, 27 nt, Artificial Sequence
  Synthetic oligonucleotide
aaucuuucagucucaagacucagccaa

SEQ ID NO: 431 - RNA, 27 nt, Artificial Sequence
  Synthetic oligonucleotide
uggcuaaaucuuucagucucaagacuc

SEQ ID NO: 432 - RNA, 27 nt, Artificial Sequence
  Synthetic oligonucleotide
uacauuauggcuaaaucuuucagucuc

SEQ ID NO: 433 - RNA, 27 nt, Artificial Sequence
  Synthetic oligonucleotide
caguuuacauuauggcuaaaucuuuca

SEQ ID NO: 434 - RNA, 27 nt, Artificial Sequence
  Synthetic oligonucleotide
aauuugaggcaguuuacauuauggcua

SEQ ID NO: 435 - RNA, 27 nt, Artificial Sequence
  Synthetic oligonucleotide
caaaguccaauuugaggcaguuuacau

SEQ ID NO: 436 - RNA, 27 nt, Artificial Sequence
  Synthetic oligonucleotide
uaugcccaaaguccaauuugaggcagu

SEQ ID NO: 437 - RNA, 27 nt, Artificial Sequence
  Synthetic oligonucleotide
ucuuuuaugcccaaaguccaauuugag

SEQ ID NO: 438 - RNA, 27 nt, Artificial Sequence
  Synthetic oligonucleotide
aaaaaguucuuuuaugcccaaagucca

SEQ ID NO: 439 - RNA, 27 nt, Artificial Sequence
  Synthetic oligonucleotide
aagcauaaaaaaguucuuuuaugccca

SEQ ID NO: 440 - RNA, 27 nt, Artificial Sequence
  Synthetic oligonucleotide
augguaagcauaaaaaaguucuuuuau

SEQ ID NO: 441 - RNA, 27 nt, Artificial Sequence
  Synthetic oligonucleotide
aaaagaugguaagcauaaaaaaguucu

SEQ ID NO: 442 - RNA, 27 nt, Artificial Sequence
  Synthetic oligonucleotide
aaaaaaaaaagaugguaagcauaaaaa

SEQ ID NO: 443 - RNA, 27 nt, Artificial Sequence
  Synthetic oligonucleotide
uaaagaaaaaaaaaagaugguaagcau

SEQ ID NO: 444 - RNA, 27 nt, Artificial Sequence
  Synthetic oligonucleotide
ucuguuaaagaaaaaaaaaagauggua

SEQ ID NO: 445 - RNA, 27 nt, Artificial Sequence
  Synthetic oligonucleotide
uacaaaucuguuaaagaaaaaaaaaag

SEQ ID NO: 446 - RNA, 27 nt, Artificial Sequence
  Synthetic oligonucleotide
auucuuaaauacaaaucuguuaaagaa

SEQ ID NO: 447 - RNA, 27 nt, Artificial Sequence
  Synthetic oligonucleotide
aaaacaauucuuaaauacaaaucuguu

SEQ ID NO: 448 - RNA, 27 nt, Artificial Sequence
  Synthetic oligonucleotide
auuuuuuaaaaacaauucuuaaauaca

SEQ ID NO: 449 - RNA, 27 nt, Artificial Sequence
  Synthetic oligonucleotide
ucuuaaaauuuuuuaaaaacaauucuu

SEQ ID NO: 450 - RNA, 27 nt, Artificial Sequence
  Synthetic oligonucleotide
auggcaauauuuacagagaaacauugu

SEQ ID NO: 451 - RNA, 27 nt, Artificial Sequence
  Synthetic oligonucleotide
uuacauuuaauggcaauauuuacagag

SEQ ID NO: 452 - RNA, 27 nt, Artificial Sequence
  Synthetic oligonucleotide
guuauuuacauuuaauggcaauauuua

SEQ ID NO: 453 - RNA, 27 nt, Artificial Sequence
  Synthetic oligonucleotide
uauuaaaguuauuuacauuuaauggca

SEQ ID NO: 454 - RNA, 27 nt, Artificial Sequence
  Synthetic oligonucleotide
guaacugcuauaaacguuuuauuaaag

SEQ ID NO: 455 - RNA, 27 nt, Artificial Sequence
  Synthetic oligonucleotide
acuauauacuaggauugaaauucugug

SEQ ID NO: 456 - RNA, 27 nt, Artificial Sequence
  Synthetic oligonucleotide
ggguuuauaguaccuauaauacuaggu

SEQ ID NO: 457 - RNA, 27 nt, Artificial Sequence
  Synthetic oligonucleotide
aaaauuaggguuuauaguaccuauaau

SEQ ID NO: 458 - RNA, 27 nt, Artificial Sequence
  Synthetic oligonucleotide
aauaaaaaaaauuaggguuuauaguac

SEQ ID NO: 459 - RNA, 27 nt, Artificial Sequence
  Synthetic oligonucleotide
uguacuuaaauaaaaaaaauuaggguu

SEQ ID NO: 460 - RNA, 27 nt, Artificial Sequence
  Synthetic oligonucleotide
caaaauguacuuaaauaaaaaaaauua

SEQ ID NO: 461 - RNA, 27 nt, Artificial Sequence
  Synthetic oligonucleotide
uuaaaaagcaaaauguacuuaaauaaa

SEQ ID NO: 462 - RNA, 27 nt, Artificial Sequence
  Synthetic oligonucleotide
caacuuuaaaaagcaaaauguacuuaa

SEQ ID NO: 463 - RNA, 27 nt, Artificial Sequence
  Synthetic oligonucleotide
aaaaaucaacuuuaaaaagcaaaaugu

SEQ ID NO: 464 - RNA, 27 nt, Artificial Sequence
  Synthetic oligonucleotide
auagaaaaaaaucaacuuuaaaaagca

SEQ ID NO: 465 - RNA, 27 nt, Artificial Sequence
  Synthetic oligonucleotide
uauuuuauuuuuucuaaaaacaauaga

SEQ ID NO: 466 - RNA, 27 nt, Artificial Sequence
  Synthetic oligonucleotide
ccaguuauuuuauuuuuucuaaaaaca

SEQ ID NO: 467 - RNA, 27 nt, Artificial Sequence
  Synthetic oligonucleotide
uauauuugccaguuauuuuauuuuuuc

SEQ ID NO: 468 - RNA, 27 nt, Artificial Sequence
  Synthetic oligonucleotide
cucaaugauauauuugccaguuauuuu

SEQ ID NO: 469 - RNA, 27 nt, Artificial Sequence
  Synthetic oligonucleotide
aagauuuggcucaaugauauauuugcc

SEQ ID NO: 470 - RNA, 27 nt, Artificial Sequence
  Synthetic oligonucleotide
uuuuuuuaagauuuggcucaaugauau

SEQ ID NO: 471 - RNA, 27 nt, Artificial Sequence
  Synthetic oligonucleotide
uuuuuuuuuuuuuaagauuuggcucaa

SEQ ID NO: 472 - RNA, 27 nt, Artificial Sequence
  Synthetic oligonucleotide
ucucgcuggaauuacuacagcgaguua

SEQ ID NO: 473 - RNA, 27 nt, Artificial Sequence
  Synthetic oligonucleotide
cucucgcuggaauuacuacagcgaguu

SEQ ID NO: 474 - RNA, 27 nt, Artificial Sequence
  Synthetic oligonucleotide
ccucucgcuggaauuacuacagcgagu

SEQ ID NO: 475 - RNA, 27 nt, Artificial Sequence
  Synthetic oligonucleotide
gccucucgcuggaauuacuacagcgag

SEQ ID NO: 476 - RNA, 27 nt, Artificial Sequence
  Synthetic oligonucleotide
ugccucucgcuggaauuacuacagcga

SEQ ID NO: 477 - RNA, 27 nt, Artificial Sequence
  Synthetic oligonucleotide
cugccucucgcuggaauuacuacagcg

SEQ ID NO: 478 - RNA, 27 nt, Artificial Sequence
  Synthetic oligonucleotide
ucugccucucgcuggaauuacuacagc

SEQ ID NO: 479 - RNA, 27 nt, Artificial Sequence
  Synthetic oligonucleotide
cucugccucucgcuggaauuacuacag

SEQ ID NO: 480 - RNA, 27 nt, Artificial Sequence
  Synthetic oligonucleotide
gaggucauaguuccuguuggugaagcu

SEQ ID NO: 481 - RNA, 27 nt, Artificial Sequence
  Synthetic oligonucleotide
cgaggucauaguuccuguuggugaagc

SEQ ID NO: 482 - RNA, 27 nt, Artificial Sequence
  Synthetic oligonucleotide
ucgaggucauaguuccuguuggugaag

SEQ ID NO: 483 - RNA, 27 nt, Artificial Sequence
  Synthetic oligonucleotide
gucgaggucauaguuccuguuggugaa

SEQ ID NO: 484 - RNA, 27 nt, Artificial Sequence
  Synthetic oligonucleotide
agucgaggucauaguuccuguugguga

SEQ ID NO: 485 - RNA, 27 nt, Artificial Sequence
  Synthetic oligonucleotide
uagucgaggucauaguuccuguuggug

SEQ ID NO: 486 - RNA, 27 nt, Artificial Sequence
  Synthetic oligonucleotide
guagucgaggucauaguuccuguuggu

SEQ ID NO: 487 - RNA, 27 nt, Artificial Sequence
  Synthetic oligonucleotide
cguagucgaggucauaguuccuguugg

SEQ ID NO: 488 - RNA, 27 nt, Artificial Sequence
  Synthetic oligonucleotide
ucguagucgaggucauaguuccuguug

SEQ ID NO: 489 - RNA, 27 nt, Artificial Sequence
  Synthetic oligonucleotide
gucguagucgaggucauaguuccuguu

SEQ ID NO: 490 - RNA, 27 nt, Artificial Sequence
  Synthetic oligonucleotide
agucguagucgaggucauaguuccugu

SEQ ID NO: 491 - RNA, 27 nt, Artificial Sequence
  Synthetic oligonucleotide
gagucguagucgaggucauaguuccug

SEQ ID NO: 492 - RNA, 27 nt, Artificial Sequence
  Synthetic oligonucleotide
cgagucguagucgaggucauaguuccu

SEQ ID NO: 493 - RNA, 27 nt, Artificial Sequence
  Synthetic oligonucleotide
ccgagucguagucgaggucauaguucc

SEQ ID NO: 494 - RNA, 27 nt, Artificial Sequence
  Synthetic oligonucleotide
accgagucguagucgaggucauaguuc

SEQ ID NO: 495 - RNA, 27 nt, Artificial Sequence
  Synthetic oligonucleotide
caccgagucguagucgaggucauaguu

SEQ ID NO: 496 - RNA, 27 nt, Artificial Sequence
  Synthetic oligonucleotide
gcaccgagucguagucgaggucauagu

SEQ ID NO: 497 - RNA, 27 nt, Artificial Sequence
  Synthetic oligonucleotide
ugcaccgagucguagucgaggucauag

SEQ ID NO: 498 - RNA, 27 nt, Artificial Sequence
  Synthetic oligonucleotide
gcucgaauuucuuccagauauccucgc

SEQ ID NO: 499 - RNA, 27 nt, Artificial Sequence
  Synthetic oligonucleotide
agcucgaauuucuuccagauauccucg

SEQ ID NO: 500 - RNA, 27 nt, Artificial Sequence
  Synthetic oligonucleotide
cagcucgaauuucuuccagauauccuc

SEQ ID NO: 501 - RNA, 27 nt, Artificial Sequence
  Synthetic oligonucleotide
gcagcucgaauuucuuccagauauccu

SEQ ID NO: 502 - RNA, 27 nt, Artificial Sequence
  Synthetic oligonucleotide
agcagcucgaauuucuuccagauaucc

SEQ ID NO: 503 - RNA, 27 nt, Artificial Sequence
  Synthetic oligonucleotide
cagcagcucgaauuucuuccagauauc

SEQ ID NO: 504 - RNA, 27 nt, Artificial Sequence
  Synthetic oligonucleotide
gcagcagcucgaauuucuuccagauau

SEQ ID NO: 505 - RNA, 27 nt, Artificial Sequence
  Synthetic oligonucleotide
ggcagcagcucgaauuucuuccagaua

SEQ ID NO: 506 - RNA, 27 nt, Artificial Sequence
  Synthetic oligonucleotide
gggcagcagcucgaauuucuuccagau

SEQ ID NO: 507 - RNA, 27 nt, Artificial Sequence
  Synthetic oligonucleotide
ugggcagcagcucgaauuucuuccaga

SEQ ID NO: 508 - RNA, 27 nt, Artificial Sequence
  Synthetic oligonucleotide
gugggcagcagcucgaauuucuuccag

SEQ ID NO: 509 - RNA, 27 nt, Artificial Sequence
  Synthetic oligonucleotide
gcgagcagagcccggagcggcggcuag

SEQ ID NO: 510 - RNA, 27 nt, Artificial Sequence
  Synthetic oligonucleotide
ggcgagcagagcccggagcggcggcua

SEQ ID NO: 511 - RNA, 27 nt, Artificial Sequence
  Synthetic oligonucleotide
gggcgagcagagcccggagcggcggcu

SEQ ID NO: 512 - RNA, 27 nt, Artificial Sequence
  Synthetic oligonucleotide
agggcgagcagagcccggagcggcggc

SEQ ID NO: 513 - RNA, 27 nt, Artificial Sequence
  Synthetic oligonucleotide
gagggcgagcagagcccggagcggcgg

SEQ ID NO: 514 - RNA, 27 nt, Artificial Sequence
  Synthetic oligonucleotide
aacucugguucaccaugucuccuccca

SEQ ID NO: 515 - RNA, 27 nt, Artificial Sequence
  Synthetic oligonucleotide
aaacucugguucaccaugucuccuccc

SEQ ID NO: 516 - RNA, 27 nt, Artificial Sequence
  Synthetic oligonucleotide
gaaacucugguucaccaugucuccucc

SEQ ID NO: 517 - RNA, 27 nt, Artificial Sequence
  Synthetic oligonucleotide
ugaaacucugguucaccaugucuccuc

SEQ ID NO: 518 - RNA, 27 nt, Artificial Sequence
  Synthetic oligonucleotide
augaaacucugguucaccaugucuccu

SEQ ID NO: 519 - RNA, 27 nt, Artificial Sequence
  Synthetic oligonucleotide
uguuuuugaugaaggucucgucguccg

SEQ ID NO: 520 - RNA, 27 nt, Artificial Sequence
  Synthetic oligonucleotide
auguuuuugaugaaggucucgucgucc

SEQ ID NO: 521 - RNA, 27 nt, Artificial Sequence
  Synthetic oligonucleotide
acauacaguccuggaugaugauguuuu

SEQ ID NO: 522 - RNA, 27 nt, Artificial Sequence
  Synthetic oligonucleotide
cacauacaguccuggaugaugauguuu

SEQ ID NO: 523 - RNA, 27 nt, Artificial Sequence
  Synthetic oligonucleotide
ccacauacaguccuggaugaugauguu

SEQ ID NO: 524 - RNA, 27 nt, Artificial Sequence
  Synthetic oligonucleotide
uccacauacaguccuggaugaugaugu

SEQ ID NO: 525 - RNA, 27 nt, Artificial Sequence
  Synthetic oligonucleotide
cuccacauacaguccuggaugaugaug

SEQ ID NO: 526 - RNA, 27 nt, Artificial Sequence
  Synthetic oligonucleotide
gcuccacauacaguccuggaugaugau

SEQ ID NO: 527 - RNA, 27 nt, Artificial Sequence
  Synthetic oligonucleotide
cgcuccacauacaguccuggaugauga

SEQ ID NO: 528 - RNA, 27 nt, Artificial Sequence
  Synthetic oligonucleotide
ccgcuccacauacaguccuggaugaug

SEQ ID NO: 529 - RNA, 27 nt, Artificial Sequence
  Synthetic oligonucleotide
gccgcuccacauacaguccuggaugau

SEQ ID NO: 530 - RNA, 27 nt, Artificial Sequence
  Synthetic oligonucleotide
agccgcuccacauacaguccuggauga

SEQ ID NO: 531 - RNA, 27 nt, Artificial Sequence
  Synthetic oligonucleotide
aagccgcuccacauacaguccuggaug

SEQ ID NO: 532 - RNA, 27 nt, Artificial Sequence
  Synthetic oligonucleotide
gaagccgcuccacauacaguccuggau

SEQ ID NO: 533 - RNA, 27 nt, Artificial Sequence
  Synthetic oligonucleotide
agaagccgcuccacauacaguccugga

SEQ ID NO: 534 - RNA, 27 nt, Artificial Sequence
  Synthetic oligonucleotide
gagaagccgcuccacauacaguccugg

SEQ ID NO: 535 - RNA, 27 nt, Artificial Sequence
  Synthetic oligonucleotide
cagccugguaggaggccagcuucucug

SEQ ID NO: 536 - RNA, 27 nt, Artificial Sequence
  Synthetic oligonucleotide
gcagccugguaggaggccagcuucucu

SEQ ID NO: 537 - RNA, 27 nt, Artificial Sequence
  Synthetic oligonucleotide
cgcagccugguaggaggccagcuucuc

SEQ ID NO: 538 - RNA, 27 nt, Artificial Sequence
  Synthetic oligonucleotide
gcgcagccugguaggaggccagcuucu

SEQ ID NO: 539 - RNA, 27 nt, Artificial Sequence
  Synthetic oligonucleotide
cgcgcagccugguaggaggccagcuuc

SEQ ID NO: 540 - RNA, 27 nt, Artificial Sequence
  Synthetic oligonucleotide
gcgcgcagccugguaggaggccagcuu

SEQ ID NO: 541 - RNA, 27 nt, Artificial Sequence
  Synthetic oligonucleotide
ugcgcgcagccugguaggaggccagcu

SEQ ID NO: 542 - RNA, 27 nt, Artificial Sequence
  Synthetic oligonucleotide
uugcgcgcagccugguaggaggccagc

SEQ ID NO: 543 - RNA, 27 nt, Artificial Sequence
  Synthetic oligonucleotide
uuugcgcgcagccugguaggaggccag

SEQ ID NO: 544 - RNA, 27 nt, Artificial Sequence
  Synthetic oligonucleotide
cuuugcgcgcagccugguaggaggcca

SEQ ID NO: 545 - RNA, 27 nt, Artificial Sequence
  Synthetic oligonucleotide
ucuuugcgcgcagccugguaggaggcc

SEQ ID NO: 546 - RNA, 27 nt, Artificial Sequence
  Synthetic oligonucleotide
gucuuugcgcgcagccugguaggaggc

SEQ ID NO: 547 - RNA, 27 nt, Artificial Sequence
  Synthetic oligonucleotide
ugucuuugcgcgcagccugguaggagg

SEQ ID NO: 548 - RNA, 27 nt, Artificial Sequence
  Synthetic oligonucleotide
cugucuuugcgcgcagccugguaggag

SEQ ID NO: 549 - RNA, 27 nt, Artificial Sequence
  Synthetic oligonucleotide
gcugucuuugcgcgcagccugguagga

SEQ ID NO: 550 - RNA, 27 nt, Artificial Sequence
  Synthetic oligonucleotide
cgcugucuuugcgcgcagccugguagg

SEQ ID NO: 551 - RNA, 27 nt, Artificial Sequence
  Synthetic oligonucleotide
ccgcugucuuugcgcgcagccugguag

SEQ ID NO: 552 - RNA, 27 nt, Artificial Sequence
  Synthetic oligonucleotide
gccgcugucuuugcgcgcagccuggua

SEQ ID NO: 553 - RNA, 27 nt, Artificial Sequence
  Synthetic oligonucleotide
ugccgcugucuuugcgcgcagccuggu

SEQ ID NO: 554 - RNA, 27 nt, Artificial Sequence
  Synthetic oligonucleotide
cugccgcugucuuugcgcgcagccugg

SEQ ID NO: 555 - RNA, 27 nt, Artificial Sequence
  Synthetic oligonucleotide
gcugccgcugucuuugcgcgcagccug

SEQ ID NO: 556 - RNA, 27 nt, Artificial Sequence
  Synthetic oligonucleotide
agcuggagguggagcagacgcuguggc

SEQ ID NO: 557 - RNA, 27 nt, Artificial Sequence
  Synthetic oligonucleotide
aagcuggagguggagcagacgcugugg

SEQ ID NO: 558 - RNA, 27 nt, Artificial Sequence
  Synthetic oligonucleotide
caagcuggagguggagcagacgcugug

SEQ ID NO: 559 - RNA, 27 nt, Artificial Sequence
  Synthetic oligonucleotide
acaagcuggagguggagcagacgcugu

SEQ ID NO: 560 - RNA, 27 nt, Artificial Sequence
  Synthetic oligonucleotide
uacaagcuggagguggagcagacgcug

SEQ ID NO: 561 - RNA, 27 nt, Artificial Sequence
  Synthetic oligonucleotide
guacaagcuggagguggagcagacgcu

SEQ ID NO: 562 - RNA, 27 nt, Artificial Sequence
  Synthetic oligonucleotide
acuugggcgagcugcugucguugagag

SEQ ID NO: 563 - RNA, 27 nt, Artificial Sequence
  Synthetic oligonucleotide
gacuugggcgagcugcugucguugaga

SEQ ID NO: 564 - RNA, 27 nt, Artificial Sequence
  Synthetic oligonucleotide
ggacuugggcgagcugcugucguugag

SEQ ID NO: 565 - RNA, 27 nt, Artificial Sequence
  Synthetic oligonucleotide
aggacuugggcgagcugcugucguuga

SEQ ID NO: 566 - RNA, 27 nt, Artificial Sequence
  Synthetic oligonucleotide
caggacuugggcgagcugcugucguug

SEQ ID NO: 567 - RNA, 27 nt, Artificial Sequence
  Synthetic oligonucleotide
ugguggugggcggugucuccucaugga

SEQ ID NO: 568 - RNA, 27 nt, Artificial Sequence
  Synthetic oligonucleotide
cugguggugggcggugucuccucaugg

SEQ ID NO: 569 - RNA, 27 nt, Artificial Sequence
  Synthetic oligonucleotide
gcugguggugggcggugucuccucaug

SEQ ID NO: 570 - RNA, 27 nt, Artificial Sequence
  Synthetic oligonucleotide
ugcugguggugggcggugucuccucau

SEQ ID NO: 571 - RNA, 27 nt, Artificial Sequence
  Synthetic oligonucleotide
cugcugguggugggcggugucuccuca

SEQ ID NO: 572 - RNA, 27 nt, Artificial Sequence
  Synthetic oligonucleotide
gcugcugguggugggcggugucuccuc

SEQ ID NO: 573 - RNA, 27 nt, Artificial Sequence
  Synthetic oligonucleotide
cgcugcugguggugggcggugucuccu

SEQ ID NO: 574 - RNA, 27 nt, Artificial Sequence
  Synthetic oligonucleotide
ucgcugcugguggugggcggugucucc

SEQ ID NO: 575 - RNA, 27 nt, Artificial Sequence
  Synthetic oligonucleotide
gucgcugcugguggugggcggugucuc

SEQ ID NO: 576 - RNA, 27 nt, Artificial Sequence
  Synthetic oligonucleotide
agucgcugcugguggugggcggugucu

SEQ ID NO: 577 - RNA, 27 nt, Artificial Sequence
  Synthetic oligonucleotide
gagucgcugcugguggugggcgguguc

SEQ ID NO: 578 - RNA, 27 nt, Artificial Sequence
  Synthetic oligonucleotide
agagucgcugcugguggugggcggugu

SEQ ID NO: 579 - RNA, 27 nt, Artificial Sequence
  Synthetic oligonucleotide
cagagucgcugcugguggugggcggug

SEQ ID NO: 580 - RNA, 27 nt, Artificial Sequence
  Synthetic oligonucleotide
ucagagucgcugcugguggugggcggu

SEQ ID NO: 581 - RNA, 27 nt, Artificial Sequence
  Synthetic oligonucleotide
cucagagucgcugcugguggugggcgg

SEQ ID NO: 582 - RNA, 27 nt, Artificial Sequence
  Synthetic oligonucleotide
ccucagagucgcugcugguggugggcg

SEQ ID NO: 583 - RNA, 27 nt, Artificial Sequence
  Synthetic oligonucleotide
uccucagagucgcugcugguggugggc

SEQ ID NO: 584 - RNA, 27 nt, Artificial Sequence
  Synthetic oligonucleotide
cuccucagagucgcugcuggugguggg

SEQ ID NO: 585 - RNA, 27 nt, Artificial Sequence
  Synthetic oligonucleotide
ccuccucagagucgcugcugguggugg

SEQ ID NO: 586 - RNA, 27 nt, Artificial Sequence
  Synthetic oligonucleotide
uccuccucagagucgcugcugguggug

SEQ ID NO: 587 - RNA, 27 nt, Artificial Sequence
  Synthetic oligonucleotide
caucgauuucuuccucaucuucuuguu

SEQ ID NO: 588 - RNA, 27 nt, Artificial Sequence
  Synthetic oligonucleotide
acaucgauuucuuccucaucuucuugu

SEQ ID NO: 589 - RNA, 27 nt, Artificial Sequence
  Synthetic oligonucleotide
cugugaggagguuugcuguggccucca

SEQ ID NO: 590 - RNA, 27 nt, Artificial Sequence
  Synthetic oligonucleotide
accucuugaggaccagugggcugugag

SEQ ID NO: 591 - RNA, 27 nt, Artificial Sequence
  Synthetic oligonucleotide
caccucuugaggaccagugggcuguga

SEQ ID NO: 592 - RNA, 27 nt, Artificial Sequence
  Synthetic oligonucleotide
gcaccucuugaggaccagugggcugug

SEQ ID NO: 593 - RNA, 27 nt, Artificial Sequence
  Synthetic oligonucleotide
ggcaccucuugaggaccagugggcugu

SEQ ID NO: 594 - RNA, 27 nt, Artificial Sequence
  Synthetic oligonucleotide
uggcaccucuugaggaccagugggcug

SEQ ID NO: 595 - RNA, 27 nt, Artificial Sequence
  Synthetic oligonucleotide
guggcaccucuugaggaccagugggcu

SEQ ID NO: 596 - RNA, 27 nt, Artificial Sequence
  Synthetic oligonucleotide
cguggcaccucuugaggaccagugggc

SEQ ID NO: 597 - RNA, 27 nt, Artificial Sequence
  Synthetic oligonucleotide
acguggcaccucuugaggaccaguggg

SEQ ID NO: 598 - RNA, 27 nt, Artificial Sequence
  Synthetic oligonucleotide
gacguggcaccucuugaggaccagugg

SEQ ID NO: 599 - RNA, 27 nt, Artificial Sequence
  Synthetic oligonucleotide
agacguggcaccucuugaggaccagug

SEQ ID NO: 600 - RNA, 27 nt, Artificial Sequence
  Synthetic oligonucleotide
gagacguggcaccucuugaggaccagu

SEQ ID NO: 601 - RNA, 27 nt, Artificial Sequence
  Synthetic oligonucleotide
ggagacguggcaccucuugaggaccag

SEQ ID NO: 602 - RNA, 27 nt, Artificial Sequence
  Synthetic oligonucleotide
uggagacguggcaccucuugaggacca

SEQ ID NO: 603 - RNA, 27 nt, Artificial Sequence
  Synthetic oligonucleotide
guggagacguggcaccucuugaggacc

SEQ ID NO: 604 - RNA, 27 nt, Artificial Sequence
  Synthetic oligonucleotide
uguggagacguggcaccucuugaggac

SEQ ID NO: 605 - RNA, 27 nt, Artificial Sequence
  Synthetic oligonucleotide
guguggagacguggcaccucuugagga

SEQ ID NO: 606 - RNA, 27 nt, Artificial Sequence
  Synthetic oligonucleotide
ucuggucacgcagggcaaaaaagcucc

SEQ ID NO: 607 - RNA, 27 nt, Artificial Sequence
  Synthetic oligonucleotide
aucuggucacgcagggcaaaaaagcuc

SEQ ID NO: 608 - RNA, 27 nt, Artificial Sequence
  Synthetic oligonucleotide
gaucuggucacgcagggcaaaaaagcu

SEQ ID NO: 609 - RNA, 27 nt, Artificial Sequence
  Synthetic oligonucleotide
ggaucuggucacgcagggcaaaaaagc

SEQ ID NO: 610 - RNA, 27 nt, Artificial Sequence
  Synthetic oligonucleotide
gggaucuggucacgcagggcaaaaaag

SEQ ID NO: 611 - RNA, 27 nt, Artificial Sequence
  Synthetic oligonucleotide
cgggaucuggucacgcagggcaaaaaa

SEQ ID NO: 612 - RNA, 27 nt, Artificial Sequence
  Synthetic oligonucleotide
ccgggaucuggucacgcagggcaaaaa

SEQ ID NO: 613 - RNA, 27 nt, Artificial Sequence
  Synthetic oligonucleotide
uccgggaucuggucacgcagggcaaaa

SEQ ID NO: 614 - RNA, 27 nt, Artificial Sequence
  Synthetic oligonucleotide
cuccgggaucuggucacgcagggcaaa

SEQ ID NO: 615 - RNA, 27 nt, Artificial Sequence
  Synthetic oligonucleotide
acuccgggaucuggucacgcagggcaa

SEQ ID NO: 616 - RNA, 27 nt, Artificial Sequence
  Synthetic oligonucleotide
aacuccgggaucuggucacgcagggca

SEQ ID NO: 617 - RNA, 27 nt, Artificial Sequence
  Synthetic oligonucleotide
uguuucaacuguucucgucguuuccgc

SEQ ID NO: 618 - RNA, 27 nt, Artificial Sequence
  Synthetic oligonucleotide
guguuucaacuguucucgucguuuccg

SEQ ID NO: 619 - RNA, 27 nt, Artificial Sequence
  Synthetic oligonucleotide
aauucuuaaauacaaaucuguuaaaga

SEQ ID NO: 620 - RNA, 27 nt, Artificial Sequence
  Synthetic oligonucleotide
caauucuuaaauacaaaucuguuaaag

SEQ ID NO: 621 - RNA, 27 nt, Artificial Sequence
  Synthetic oligonucleotide
cguuuuauuaaaguuauuuacauuuaa

SEQ ID NO: 622 - RNA, 27 nt, Artificial Sequence
  Synthetic oligonucleotide
acguuuuauuaaaguuauuuacauuua

SEQ ID NO: 623 - RNA, 27 nt, Artificial Sequence
  Synthetic oligonucleotide
aacguuuuauuaaaguuauuuacauuu

SEQ ID NO: 624 - RNA, 27 nt, Artificial Sequence
  Synthetic oligonucleotide
aaacguuuuauuaaaguuauuuacauu

SEQ ID NO: 625 - RNA, 27 nt, Artificial Sequence
  Synthetic oligonucleotide
uaaacguuuuauuaaaguuauuuacau

SEQ ID NO: 626 - RNA, 27 nt, Artificial Sequence
  Synthetic oligonucleotide
auaaacguuuuauuaaaguuauuuaca

SEQ ID NO: 627 - RNA, 27 nt, Artificial Sequence
  Synthetic oligonucleotide
uauaaacguuuuauuaaaguuauuuac

SEQ ID NO: 628 - RNA, 27 nt, Artificial Sequence
  Synthetic oligonucleotide
cuauaaacguuuuauuaaaguuauuua

SEQ ID NO: 629 - RNA, 27 nt, Artificial Sequence
  Synthetic oligonucleotide
gcuauaaacguuuuauuaaaguuauuu

SEQ ID NO: 630 - RNA, 27 nt, Artificial Sequence
  Synthetic oligonucleotide
ugcuauaaacguuuuauuaaaguuauu

SEQ ID NO: 631 - RNA, 27 nt, Artificial Sequence
  Synthetic oligonucleotide
cugcuauaaacguuuuauuaaaguuau

SEQ ID NO: 632 - RNA, 27 nt, Artificial Sequence
  Synthetic oligonucleotide
acugcuauaaacguuuuauuaaaguua

SEQ ID NO: 633 - RNA, 27 nt, Artificial Sequence
  Synthetic oligonucleotide
aacugcuauaaacguuuuauuaaaguu

SEQ ID NO: 634 - RNA, 27 nt, Artificial Sequence
  Synthetic oligonucleotide
aauagaaaaaaaucaacuuuaaaaagc

SEQ ID NO: 635 - RNA, 27 nt, Artificial Sequence
  Synthetic oligonucleotide
caauagaaaaaaaucaacuuuaaaaag

SEQ ID NO: 636 - RNA, 27 nt, Artificial Sequence
  Synthetic oligonucleotide
acaauagaaaaaaaucaacuuuaaaaa

SEQ ID NO: 637 - RNA, 27 nt, Artificial Sequence
  Synthetic oligonucleotide
aacaauagaaaaaaaucaacuuuaaaa

SEQ ID NO: 638 - RNA, 27 nt, Artificial Sequence
  Synthetic oligonucleotide
aaacaauagaaaaaaaucaacuuuaaa

SEQ ID NO: 639 - RNA, 27 nt, Artificial Sequence
  Synthetic oligonucleotide
aaaacaauagaaaaaaaucaacuuuaa

SEQ ID NO: 640 - RNA, 27 nt, Artificial Sequence
  Synthetic oligonucleotide
aaaaacaauagaaaaaaaucaacuuua

SEQ ID NO: 641 - RNA, 27 nt, Artificial Sequence
  Synthetic oligonucleotide
uaaaaacaauagaaaaaaaucaacuuu

SEQ ID NO: 642 - RNA, 27 nt, Artificial Sequence
  Synthetic oligonucleotide
cuaaaaacaauagaaaaaaaucaacuu

SEQ ID NO: 643 - RNA, 27 nt, Artificial Sequence
  Synthetic oligonucleotide
ucuaaaaacaauagaaaaaaaucaacu

SEQ ID NO: 644 - RNA, 27 nt, Artificial Sequence
  Synthetic oligonucleotide
uucuaaaaacaauagaaaaaaaucaac

SEQ ID NO: 645 - RNA, 27 nt, Artificial Sequence
  Synthetic oligonucleotide
uuucuaaaaacaauagaaaaaaaucaa

SEQ ID NO: 646 - RNA, 27 nt, Artificial Sequence
  Synthetic oligonucleotide
uuuucuaaaaacaauagaaaaaaauca

SEQ ID NO: 647 - RNA, 27 nt, Artificial Sequence
  Synthetic oligonucleotide
uuuuucuaaaaacaauagaaaaaaauc

SEQ ID NO: 648 - RNA, 27 nt, Artificial Sequence
  Synthetic oligonucleotide
uuuuuucuaaaaacaauagaaaaaaau

SEQ ID NO: 649 - RNA, 27 nt, Artificial Sequence
  Synthetic oligonucleotide
auuuuuucuaaaaacaauagaaaaaaa

SEQ ID NO: 650 - RNA, 27 nt, Artificial Sequence
  Synthetic oligonucleotide
uauuuuuucuaaaaacaauagaaaaaa

SEQ ID NO: 651 - RNA, 27 nt, Artificial Sequence
  Synthetic oligonucleotide
uuauuuuuucuaaaaacaauagaaaaa

SEQ ID NO: 652 - RNA, 27 nt, Artificial Sequence
  Synthetic oligonucleotide
uuuauuuuuucuaaaaacaauagaaaa

SEQ ID NO: 653 - RNA, 27 nt, Artificial Sequence
  Synthetic oligonucleotide
uuuuauuuuuucuaaaaacaauagaaa

SEQ ID NO: 654 - RNA, 27 nt, Artificial Sequence
  Synthetic oligonucleotide
auuuuauuuuuucuaaaaacaauagaa

SEQ ID NO: 655 - DNA, 27 bp, Artificial Sequence
  Synthetic oligonucleotide
ctcgagaagggcagggcttctcagagg

SEQ ID NO: 656 - DNA, 27 bp, Artificial Sequence
  Synthetic oligonucleotide
gggctttatctaactcgctgtagtaat

SEQ ID NO: 657 - DNA, 27 bp, Artificial Sequence
  Synthetic oligonucleotide
aacccttgccgcatccacgaaactttg

SEQ ID NO: 658 - DNA, 27 bp, Artificial Sequence
  Synthetic oligonucleotide
ttgccgcatccacgaaactttgcccat

SEQ ID NO: 659 - DNA, 27 bp, Artificial Sequence
  Synthetic oligonucleotide
catccacgaaactttgcccatagcagc

SEQ ID NO: 660 - DNA, 27 bp, Artificial Sequence
  Synthetic oligonucleotide
gggcgggcactttgcactggaacttac

SEQ ID NO: 661 - DNA, 27 bp, Artificial Sequence
  Synthetic oligonucleotide
gcactttgcactggaacttacaacacc

SEQ ID NO: 662 - DNA, 27 bp, Artificial Sequence
  Synthetic oligonucleotide
cactggaacttacaacacccgagcaag

SEQ ID NO: 663 - DNA, 27 bp, Artificial Sequence
  Synthetic oligonucleotide
ttgcagctgcttagacgctggattttt

SEQ ID NO: 664 - DNA, 27 bp, Artificial Sequence
  Synthetic oligonucleotide
ctgcttagacgctggatttttttcggg

SEQ ID NO: 665 - DNA, 27 bp, Artificial Sequence
  Synthetic oligonucleotide
gacgctggatttttttcgggtagtgga

SEQ ID NO: 666 - DNA, 27 bp, Artificial Sequence
  Synthetic oligonucleotide
tggatttttttcgggtagtggaaaacc

SEQ ID NO: 667 - DNA, 27 bp, Artificial Sequence
  Synthetic oligonucleotide
ttcgggtagtggaaaaccagcagcctc

SEQ ID NO: 668 - DNA, 27 bp, Artificial Sequence
  Synthetic oligonucleotide
ccctcaacgttagcttcaccaacagga

SEQ ID NO: 669 - DNA, 27 bp, Artificial Sequence
  Synthetic oligonucleotide
acgttagcttcaccaacaggaactatg

SEQ ID NO: 670 - DNA, 27 bp, Artificial Sequence
  Synthetic oligonucleotide
acgactcggtgcagccgtatttctact

SEQ ID NO: 671 - DNA, 27 bp, Artificial Sequence
  Synthetic oligonucleotide
gtgcagccgtatttctactgcgacgag

SEQ ID NO: 672 - DNA, 27 bp, Artificial Sequence
  Synthetic oligonucleotide
aggaggagaacttctaccagcagcagc

SEQ ID NO: 673 - DNA, 27 bp, Artificial Sequence
  Synthetic oligonucleotide
cagcgaggatatctggaagaaattcga

SEQ ID NO: 674 - DNA, 27 bp, Artificial Sequence
  Synthetic oligonucleotide
tacgttgcggtcacacccttctccctt

SEQ ID NO: 675 - DNA, 27 bp, Artificial Sequence
  Synthetic oligonucleotide
agacatggtgaaccagagtttcatctg

SEQ ID NO: 676 - DNA, 27 bp, Artificial Sequence
  Synthetic oligonucleotide
acccggacgacgagaccttcatcaaaa

SEQ ID NO: 677 - DNA, 27 bp, Artificial Sequence
  Synthetic oligonucleotide
acgagaccttcatcaaaaacatcatca

SEQ ID NO: 678 - DNA, 27 bp, Artificial Sequence
  Synthetic oligonucleotide
tcaaaaacatcatcatccaggactgta

SEQ ID NO: 679 - DNA, 27 bp, Artificial Sequence
  Synthetic oligonucleotide
caggactgtatgtggagcggcttctcg

SEQ ID NO: 680 - DNA, 27 bp, Artificial Sequence
  Synthetic oligonucleotide
gtctgctccacctccagcttgtacctg

SEQ ID NO: 681 - DNA, 27 bp, Artificial Sequence
  Synthetic oligonucleotide
ccacctccagcttgtacctgcaggatc

SEQ ID NO: 682 - DNA, 27 bp, Artificial Sequence
  Synthetic oligonucleotide
tccagcttgtacctgcaggatctgagc

SEQ ID NO: 683 - DNA, 27 bp, Artificial Sequence
  Synthetic oligonucleotide
ccaagtcctgcgcctcgcaagactcca

SEQ ID NO: 684 - DNA, 27 bp, Artificial Sequence
  Synthetic oligonucleotide
cagcagcgactctgaggaggaacaaga

SEQ ID NO: 685 - DNA, 27 bp, Artificial Sequence
  Synthetic oligonucleotide
cgactctgaggaggaacaagaagatga

SEQ ID NO: 686 - DNA, 27 bp, Artificial Sequence
  Synthetic oligonucleotide
ctgaggaggaacaagaagatgaggaag

SEQ ID NO: 687 - DNA, 27 bp, Artificial Sequence
  Synthetic oligonucleotide
ggaacaagaagatgaggaagaaatcga

SEQ ID NO: 688 - DNA, 27 bp, Artificial Sequence
  Synthetic oligonucleotide
agaagatgaggaagaaatcgatgttgt

SEQ ID NO: 689 - DNA, 27 bp, Artificial Sequence
  Synthetic oligonucleotide
tgaggaagaaatcgatgttgtttctgt

SEQ ID NO: 690 - DNA, 27 bp, Artificial Sequence
  Synthetic oligonucleotide
agaaatcgatgttgtttctgtggaaaa

SEQ ID NO: 691 - DNA, 27 bp, Artificial Sequence
  Synthetic oligonucleotide
cgatgttgtttctgtggaaaagaggca

SEQ ID NO: 692 - DNA, 27 bp, Artificial Sequence
  Synthetic oligonucleotide
aagaggcaggctcctggcaaaaggtca

SEQ ID NO: 693 - DNA, 27 bp, Artificial Sequence
  Synthetic oligonucleotide
gcaggctcctggcaaaaggtcagagtc

SEQ ID NO: 694 - DNA, 27 bp, Artificial Sequence
  Synthetic oligonucleotide
ctcctggcaaaaggtcagagtctggat

SEQ ID NO: 695 - DNA, 27 bp, Artificial Sequence
  Synthetic oligonucleotide
ggcaaaaggtcagagtctggatcacct

SEQ ID NO: 696 - DNA, 27 bp, Artificial Sequence
  Synthetic oligonucleotide
aaggtcagagtctggatcaccttctgc

SEQ ID NO: 697 - DNA, 27 bp, Artificial Sequence
  Synthetic oligonucleotide
cagcaaacctcctcacagcccactggt

SEQ ID NO: 698 - DNA, 27 bp, Artificial Sequence
  Synthetic oligonucleotide
ctcctcacagcccactggtcctcaaga

SEQ ID NO: 699 - DNA, 27 bp, Artificial Sequence
  Synthetic oligonucleotide
ctccctccactcggaaggactatcctg

SEQ ID NO: 700 - DNA, 27 bp, Artificial Sequence
  Synthetic oligonucleotide
cactcggaaggactatcctgctgccaa

SEQ ID NO: 701 - DNA, 27 bp, Artificial Sequence
  Synthetic oligonucleotide
ctatcctgctgccaagagggtcaagtt

SEQ ID NO: 702 - DNA, 27 bp, Artificial Sequence
  Synthetic oligonucleotide
ctgctgccaagagggtcaagttggaca

SEQ ID NO: 703 - DNA, 27 bp, Artificial Sequence
  Synthetic oligonucleotide
gccaagagggtcaagttggacagtgtc

SEQ ID NO: 704 - DNA, 27 bp, Artificial Sequence
  Synthetic oligonucleotide
gagggtcaagttggacagtgtcagagt

SEQ ID NO: 705 - DNA, 27 bp, Artificial Sequence
  Synthetic oligonucleotide
tcaagttggacagtgtcagagtcctga

SEQ ID NO: 706 - DNA, 27 bp, Artificial Sequence
  Synthetic oligonucleotide
ttggacagtgtcagagtcctgagacag

SEQ ID NO: 707 - DNA, 27 bp, Artificial Sequence
  Synthetic oligonucleotide
gtcagagtcctgagacagatcagcaac

SEQ ID NO: 708 - DNA, 27 bp, Artificial Sequence
  Synthetic oligonucleotide
ctgagacagatcagcaacaaccgaaaa

SEQ ID NO: 709 - DNA, 27 bp, Artificial Sequence
  Synthetic oligonucleotide
cagatcagcaacaaccgaaaatgcacc

SEQ ID NO: 710 - DNA, 27 bp, Artificial Sequence
  Synthetic oligonucleotide
gtcctcggacaccgaggagaatgtcaa

SEQ ID NO: 711 - DNA, 27 bp, Artificial Sequence
  Synthetic oligonucleotide
cggacaccgaggagaatgtcaagaggc

SEQ ID NO: 712 - DNA, 27 bp, Artificial Sequence
  Synthetic oligonucleotide
gccagaggaggaacgagctaaaacgga

SEQ ID NO: 713 - DNA, 27 bp, Artificial Sequence
  Synthetic oligonucleotide
ggaggaacgagctaaaacggagctttt

SEQ ID NO: 714 - DNA, 27 bp, Artificial Sequence
  Synthetic oligonucleotide
aacgagctaaaacggagcttttttgcc

SEQ ID NO: 715 - DNA, 27 bp, Artificial Sequence
  Synthetic oligonucleotide
ctaaaacggagcttttttgccctgcgt

SEQ ID NO: 716 - DNA, 27 bp, Artificial Sequence
  Synthetic oligonucleotide
acggagcttttttgccctgcgtgacca

SEQ ID NO: 717 - DNA, 27 bp, Artificial Sequence
  Synthetic oligonucleotide
gtgaccagatcccggagttggaaaaca

SEQ ID NO: 718 - DNA, 27 bp, Artificial Sequence
  Synthetic oligonucleotide
cagatcccggagttggaaaacaatgaa

SEQ ID NO: 719 - DNA, 27 bp, Artificial Sequence
  Synthetic oligonucleotide
cccggagttggaaaacaatgaaaaggc

SEQ ID NO: 720 - DNA, 27 bp, Artificial Sequence
  Synthetic oligonucleotide
caaggtagttatccttaaaaaagccac

SEQ ID NO: 721 - DNA, 27 bp, Artificial Sequence
  Synthetic oligonucleotide
tagttatccttaaaaaagccacagcat

SEQ ID NO: 722 - DNA, 27 bp, Artificial Sequence
  Synthetic oligonucleotide
atccttaaaaaagccacagcatacatc

SEQ ID NO: 723 - DNA, 27 bp, Artificial Sequence
  Synthetic oligonucleotide
taaaaaagccacagcatacatcctgtc

SEQ ID NO: 724 - DNA, 27 bp, Artificial Sequence
  Synthetic oligonucleotide
aagccacagcatacatcctgtccgtcc

SEQ ID NO: 725 - DNA, 27 bp, Artificial Sequence
  Synthetic oligonucleotide
cagcatacatcctgtccgtccaagcag

SEQ ID NO: 726 - DNA, 27 bp, Artificial Sequence
  Synthetic oligonucleotide
atcctgtccgtccaagcagaggagcaa

SEQ ID NO: 727 - DNA, 27 bp, Artificial Sequence
  Synthetic oligonucleotide
gtccgtccaagcagaggagcaaaagct

SEQ ID NO: 728 - DNA, 27 bp, Artificial Sequence
  Synthetic oligonucleotide
aagcagaggagcaaaagctcatttctg

SEQ ID NO: 729 - DNA, 27 bp, Artificial Sequence
  Synthetic oligonucleotide
ggagcaaaagctcatttctgaagagga

SEQ ID NO: 730 - DNA, 27 bp, Artificial Sequence
  Synthetic oligonucleotide
aaaagctcatttctgaagaggacttgt

SEQ ID NO: 731 - DNA, 27 bp, Artificial Sequence
  Synthetic oligonucleotide
tcatttctgaagaggacttgttgcgga

SEQ ID NO: 732 - DNA, 27 bp, Artificial Sequence
  Synthetic oligonucleotide
ctgaagaggacttgttgcggaaacgac

SEQ ID NO: 733 - DNA, 27 bp, Artificial Sequence
  Synthetic oligonucleotide
gaggacttgttgcggaaacgacgagaa

SEQ ID NO: 734 - DNA, 27 bp, Artificial Sequence
  Synthetic oligonucleotide
cttgttgcggaaacgacgagaacagtt

SEQ ID NO: 735 - DNA, 27 bp, Artificial Sequence
  Synthetic oligonucleotide
tgcggaaacgacgagaacagttgaaac

SEQ ID NO: 736 - DNA, 27 bp, Artificial Sequence
  Synthetic oligonucleotide
acaaacttgaacagctacggaactctt

SEQ ID NO: 737 - DNA, 27 bp, Artificial Sequence
  Synthetic oligonucleotide
ttgaacagctacggaactcttgtgcgt

SEQ ID NO: 738 - DNA, 27 bp, Artificial Sequence
  Synthetic oligonucleotide
cagctacggaactcttgtgcgtaagga

SEQ ID NO: 739 - DNA, 27 bp, Artificial Sequence
  Synthetic oligonucleotide
ggaactcttgtgcgtaaggaaaagtaa

SEQ ID NO: 740 - DNA, 27 bp, Artificial Sequence
  Synthetic oligonucleotide
cttgtgcgtaaggaaaagtaaggaaaa

SEQ ID NO: 741 - DNA, 27 bp, Artificial Sequence
  Synthetic oligonucleotide
gcgtaaggaaaagtaaggaaaacgatt

SEQ ID NO: 742 - DNA, 27 bp, Artificial Sequence
  Synthetic oligonucleotide
aagtaaggaaaacgattccttctaaca

SEQ ID NO: 743 - DNA, 27 bp, Artificial Sequence
  Synthetic oligonucleotide
aggaaaacgattccttctaacagaaat

SEQ ID NO: 744 - DNA, 27 bp, Artificial Sequence
  Synthetic oligonucleotide
aacgattccttctaacagaaatgtcct

SEQ ID NO: 745 - DNA, 27 bp, Artificial Sequence
  Synthetic oligonucleotide
tccttctaacagaaatgtcctgagcaa

SEQ ID NO: 746 - DNA, 27 bp, Artificial Sequence
  Synthetic oligonucleotide
aacagaaatgtcctgagcaatcaccta

SEQ ID NO: 747 - DNA, 27 bp, Artificial Sequence
  Synthetic oligonucleotide
gtcctgagcaatcacctatgaacttgt

SEQ ID NO: 748 - DNA, 27 bp, Artificial Sequence
  Synthetic oligonucleotide
agcaatcacctatgaacttgtttcaaa

SEQ ID NO: 749 - DNA, 27 bp, Artificial Sequence
  Synthetic oligonucleotide
cacctatgaacttgtttcaaatgcatg

SEQ ID NO: 750 - DNA, 27 bp, Artificial Sequence
  Synthetic oligonucleotide
atgaacttgtttcaaatgcatgatcaa

SEQ ID NO: 751 - DNA, 27 bp, Artificial Sequence
  Synthetic oligonucleotide
ttgtttcaaatgcatgatcaaatgcaa

SEQ ID NO: 752 - DNA, 27 bp, Artificial Sequence
  Synthetic oligonucleotide
tcaaatgcatgatcaaatgcaacctca

SEQ ID NO: 753 - DNA, 27 bp, Artificial Sequence
  Synthetic oligonucleotide
atgatcaaatgcaacctcacaaccttg

SEQ ID NO: 754 - DNA, 27 bp, Artificial Sequence
  Synthetic oligonucleotide
caaatgcaacctcacaaccttggctga

SEQ ID NO: 755 - DNA, 27 bp, Artificial Sequence
  Synthetic oligonucleotide
aacctcacaaccttggctgagtcttga

SEQ ID NO: 756 - DNA, 27 bp, Artificial Sequence
  Synthetic oligonucleotide
cacaaccttggctgagtcttgagactg

SEQ ID NO: 757 - DNA, 27 bp, Artificial Sequence
  Synthetic oligonucleotide
ttggctgagtcttgagactgaaagatt

SEQ ID NO: 758 - DNA, 27 bp, Artificial Sequence
  Synthetic oligonucleotide
gagtcttgagactgaaagatttagcca

SEQ ID NO: 759 - DNA, 27 bp, Artificial Sequence
  Synthetic oligonucleotide
gagactgaaagatttagccataatgta

SEQ ID NO: 760 - DNA, 27 bp, Artificial Sequence
  Synthetic oligonucleotide
tgaaagatttagccataatgtaaactg

SEQ ID NO: 761 - DNA, 27 bp, Artificial Sequence
  Synthetic oligonucleotide
tagccataatgtaaactgcctcaaatt

SEQ ID NO: 762 - DNA, 27 bp, Artificial Sequence
  Synthetic oligonucleotide
atgtaaactgcctcaaattggactttg

SEQ ID NO: 763 - DNA, 27 bp, Artificial Sequence
  Synthetic oligonucleotide
actgcctcaaattggactttgggcata

SEQ ID NO: 764 - DNA, 27 bp, Artificial Sequence
  Synthetic oligonucleotide
ctcaaattggactttgggcataaaaga

SEQ ID NO: 765 - DNA, 27 bp, Artificial Sequence
  Synthetic oligonucleotide
tggactttgggcataaaagaacttttt

SEQ ID NO: 766 - DNA, 27 bp, Artificial Sequence
  Synthetic oligonucleotide
tgggcataaaagaacttttttatgctt

SEQ ID NO: 767 - DNA, 27 bp, Artificial Sequence
  Synthetic oligonucleotide
ataaaagaacttttttatgcttaccat

SEQ ID NO: 768 - DNA, 27 bp, Artificial Sequence
  Synthetic oligonucleotide
agaacttttttatgcttaccatctttt

SEQ ID NO: 769 - DNA, 27 bp, Artificial Sequence
  Synthetic oligonucleotide
tttttatgcttaccatctttttttttt

SEQ ID NO: 770 - DNA, 27 bp, Artificial Sequence
  Synthetic oligonucleotide
atgcttaccatcttttttttttcttta

SEQ ID NO: 771 - DNA, 27 bp, Artificial Sequence
  Synthetic oligonucleotide
taccatcttttttttttctttaacaga

SEQ ID NO: 772 - DNA, 27 bp, Artificial Sequence
  Synthetic oligonucleotide
cttttttttttctttaacagatttgta

SEQ ID NO: 773 - DNA, 27 bp, Artificial Sequence
  Synthetic oligonucleotide
ttctttaacagatttgtatttaagaat

SEQ ID NO: 774 - DNA, 27 bp, Artificial Sequence
  Synthetic oligonucleotide
aacagatttgtatttaagaattgtttt

SEQ ID NO: 775 - DNA, 27 bp, Artificial Sequence
  Synthetic oligonucleotide
tgtatttaagaattgtttttaaaaaat

SEQ ID NO: 776 - DNA, 27 bp, Artificial Sequence
  Synthetic oligonucleotide
aagaattgtttttaaaaaattttaaga

SEQ ID NO: 777 - DNA, 27 bp, Artificial Sequence
  Synthetic oligonucleotide
acaatgtttctctgtaaatattgccat

SEQ ID NO: 778 - DNA, 27 bp, Artificial Sequence
  Synthetic oligonucleotide
ctctgtaaatattgccattaaatgtaa

SEQ ID NO: 779 - DNA, 27 bp, Artificial Sequence
  Synthetic oligonucleotide
taaatattgccattaaatgtaaataac

SEQ ID NO: 780 - DNA, 27 bp, Artificial Sequence
  Synthetic oligonucleotide
tgccattaaatgtaaataactttaata

SEQ ID NO: 781 - DNA, 27 bp, Artificial Sequence
  Synthetic oligonucleotide
ctttaataaaacgtttatagcagttac

SEQ ID NO: 782 - DNA, 27 bp, Artificial Sequence
  Synthetic oligonucleotide
cacagaatttcaatcctagtatatagt

SEQ ID NO: 783 - DNA, 27 bp, Artificial Sequence
  Synthetic oligonucleotide
acctagtattataggtactataaaccc

SEQ ID NO: 784 - DNA, 27 bp, Artificial Sequence
  Synthetic oligonucleotide
attataggtactataaaccctaatttt

SEQ ID NO: 785 - DNA, 27 bp, Artificial Sequence
  Synthetic oligonucleotide
gtactataaaccctaattttttttatt

SEQ ID NO: 786 - DNA, 27 bp, Artificial Sequence
  Synthetic oligonucleotide
aaccctaattttttttatttaagtaca

SEQ ID NO: 787 - DNA, 27 bp, Artificial Sequence
  Synthetic oligonucleotide
taattttttttatttaagtacattttg

SEQ ID NO: 788 - DNA, 27 bp, Artificial Sequence
  Synthetic oligonucleotide
tttatttaagtacattttgctttttaa

SEQ ID NO: 789 - DNA, 27 bp, Artificial Sequence
  Synthetic oligonucleotide
ttaagtacattttgctttttaaagttg

SEQ ID NO: 790 - DNA, 27 bp, Artificial Sequence
  Synthetic oligonucleotide
acattttgctttttaaagttgattttt

SEQ ID NO: 791 - DNA, 27 bp, Artificial Sequence
  Synthetic oligonucleotide
tgctttttaaagttgatttttttctat

SEQ ID NO: 792 - DNA, 27 bp, Artificial Sequence
  Synthetic oligonucleotide
tctattgtttttagaaaaaataaaata

SEQ ID NO: 793 - DNA, 27 bp, Artificial Sequence
  Synthetic oligonucleotide
tgtttttagaaaaaataaaataactgg

SEQ ID NO: 794 - DNA, 27 bp, Artificial Sequence
  Synthetic oligonucleotide
gaaaaaataaaataactggcaaatata

SEQ ID NO: 795 - DNA, 27 bp, Artificial Sequence
  Synthetic oligonucleotide
aaaataactggcaaatatatcattgag

SEQ ID NO: 796 - DNA, 27 bp, Artificial Sequence
  Synthetic oligonucleotide
ggcaaatatatcattgagccaaatctt

SEQ ID NO: 797 - DNA, 27 bp, Artificial Sequence
  Synthetic oligonucleotide
atatcattgagccaaatcttaaaaaaa

SEQ ID NO: 798 - DNA, 27 bp, Artificial Sequence
  Synthetic oligonucleotide
ttgagccaaatcttaaaaaaaaaaaaa

SEQ ID NO: 799 - DNA, 27 bp, Artificial Sequence
  Synthetic oligonucleotide
taactcgctgtagtaattccagcgaga

SEQ ID NO: 800 - DNA, 27 bp, Artificial Sequence
  Synthetic oligonucleotide
aactcgctgtagtaattccagcgagag

SEQ ID NO: 801 - DNA, 27 bp, Artificial Sequence
  Synthetic oligonucleotide
actcgctgtagtaattccagcgagagg

SEQ ID NO: 802 - DNA, 27 bp, Artificial Sequence
  Synthetic oligonucleotide
ctcgctgtagtaattccagcgagaggc

SEQ ID NO: 803 - DNA, 27 bp, Artificial Sequence
  Synthetic oligonucleotide
tcgctgtagtaattccagcgagaggca

SEQ ID NO: 804 - DNA, 27 bp, Artificial Sequence
  Synthetic oligonucleotide
cgctgtagtaattccagcgagaggcag

SEQ ID NO: 805 - DNA, 27 bp, Artificial Sequence
  Synthetic oligonucleotide
gctgtagtaattccagcgagaggcaga

SEQ ID NO: 806 - DNA, 27 bp, Artificial Sequence
  Synthetic oligonucleotide
ctgtagtaattccagcgagaggcagag

SEQ ID NO: 807 - DNA, 27 bp, Artificial Sequence
  Synthetic oligonucleotide
agcttcaccaacaggaactatgacctc

SEQ ID NO: 808 - DNA, 27 bp, Artificial Sequence
  Synthetic oligonucleotide
gcttcaccaacaggaactatgacctcg

SEQ ID NO: 809 - DNA, 27 bp, Artificial Sequence
  Synthetic oligonucleotide
cttcaccaacaggaactatgacctcga

SEQ ID NO: 810 - DNA, 27 bp, Artificial Sequence
  Synthetic oligonucleotide
ttcaccaacaggaactatgacctcgac

SEQ ID NO: 811 - DNA, 27 bp, Artificial Sequence
  Synthetic oligonucleotide
tcaccaacaggaactatgacctcgact

SEQ ID NO: 812 - DNA, 27 bp, Artificial Sequence
  Synthetic oligonucleotide
caccaacaggaactatgacctcgacta

SEQ ID NO: 813 - DNA, 27 bp, Artificial Sequence
  Synthetic oligonucleotide
accaacaggaactatgacctcgactac

SEQ ID NO: 814 - DNA, 27 bp, Artificial Sequence
  Synthetic oligonucleotide
ccaacaggaactatgacctcgactacg

SEQ ID NO: 815 - DNA, 27 bp, Artificial Sequence
  Synthetic oligonucleotide
caacaggaactatgacctcgactacga

SEQ ID NO: 816 - DNA, 27 bp, Artificial Sequence
  Synthetic oligonucleotide
aacaggaactatgacctcgactacgac

SEQ ID NO: 817 - DNA, 27 bp, Artificial Sequence
  Synthetic oligonucleotide
acaggaactatgacctcgactacgact

SEQ ID NO: 818 - DNA, 27 bp, Artificial Sequence
  Synthetic oligonucleotide
caggaactatgacctcgactacgactc

SEQ ID NO: 819 - DNA, 27 bp, Artificial Sequence
  Synthetic oligonucleotide
aggaactatgacctcgactacgactcg

SEQ ID NO: 820 - DNA, 27 bp, Artificial Sequence
  Synthetic oligonucleotide
ggaactatgacctcgactacgactcgg

SEQ ID NO: 821 - DNA, 27 bp, Artificial Sequence
  Synthetic oligonucleotide
gaactatgacctcgactacgactcggt

SEQ ID NO: 822 - DNA, 27 bp, Artificial Sequence
  Synthetic oligonucleotide
aactatgacctcgactacgactcggtg

SEQ ID NO: 823 - DNA, 27 bp, Artificial Sequence
  Synthetic oligonucleotide
actatgacctcgactacgactcggtgc

SEQ ID NO: 824 - DNA, 27 bp, Artificial Sequence
  Synthetic oligonucleotide
ctatgacctcgactacgactcggtgca

SEQ ID NO: 825 - DNA, 27 bp, Artificial Sequence
  Synthetic oligonucleotide
gcgaggatatctggaagaaattcgagc

SEQ ID NO: 826 - DNA, 27 bp, Artificial Sequence
  Synthetic oligonucleotide
cgaggatatctggaagaaattcgagct

SEQ ID NO: 827 - DNA, 27 bp, Artificial Sequence
  Synthetic oligonucleotide
gaggatatctggaagaaattcgagctg

SEQ ID NO: 828 - DNA, 27 bp, Artificial Sequence
  Synthetic oligonucleotide
aggatatctggaagaaattcgagctgc

SEQ ID NO: 829 - DNA, 27 bp, Artificial Sequence
  Synthetic oligonucleotide
ggatatctggaagaaattcgagctgct

SEQ ID NO: 830 - DNA, 27 bp, Artificial Sequence
  Synthetic oligonucleotide
gatatctggaagaaattcgagctgctg

SEQ ID NO: 831 - DNA, 27 bp, Artificial Sequence
  Synthetic oligonucleotide
atatctggaagaaattcgagctgctgc

SEQ ID NO: 832 - DNA, 27 bp, Artificial Sequence
  Synthetic oligonucleotide
tatctggaagaaattcgagctgctgcc

SEQ ID NO: 833 - DNA, 27 bp, Artificial Sequence
  Synthetic oligonucleotide
atctggaagaaattcgagctgctgccc

SEQ ID NO: 834 - DNA, 27 bp, Artificial Sequence
  Synthetic oligonucleotide
tctggaagaaattcgagctgctgccca

SEQ ID NO: 835 - DNA, 27 bp, Artificial Sequence
  Synthetic oligonucleotide
ctggaagaaattcgagctgctgcccac

SEQ ID NO: 836 - DNA, 27 bp, Artificial Sequence
  Synthetic oligonucleotide
ctagccgccgctccgggctctgctcgc

SEQ ID NO: 837 - DNA, 27 bp, Artificial Sequence
  Synthetic oligonucleotide
tagccgccgctccgggctctgctcgcc

SEQ ID NO: 838 - DNA, 27 bp, Artificial Sequence
  Synthetic oligonucleotide
agccgccgctccgggctctgctcgccc

SEQ ID NO: 839 - DNA, 27 bp, Artificial Sequence
  Synthetic oligonucleotide
gccgccgctccgggctctgctcgccct

SEQ ID NO: 840 - DNA, 27 bp, Artificial Sequence
  Synthetic oligonucleotide
ccgccgctccgggctctgctcgccctc

SEQ ID NO: 841 - DNA, 27 bp, Artificial Sequence
  Synthetic oligonucleotide
tgggaggagacatggtgaaccagagtt

SEQ ID NO: 842 - DNA, 27 bp, Artificial Sequence
  Synthetic oligonucleotide
gggaggagacatggtgaaccagagttt

SEQ ID NO: 843 - DNA, 27 bp, Artificial Sequence
  Synthetic oligonucleotide
ggaggagacatggtgaaccagagtttc

SEQ ID NO: 844 - DNA, 27 bp, Artificial Sequence
  Synthetic oligonucleotide
gaggagacatggtgaaccagagtttca

SEQ ID NO: 845 - DNA, 27 bp, Artificial Sequence
  Synthetic oligonucleotide
aggagacatggtgaaccagagtttcat

SEQ ID NO: 846 - DNA, 27 bp, Artificial Sequence
  Synthetic oligonucleotide
cggacgacgagaccttcatcaaaaaca

SEQ ID NO: 847 - DNA, 27 bp, Artificial Sequence
  Synthetic oligonucleotide
ggacgacgagaccttcatcaaaaacat

SEQ ID NO: 848 - DNA, 27 bp, Artificial Sequence
  Synthetic oligonucleotide
aaaacatcatcatccaggactgtatgt

SEQ ID NO: 849 - DNA, 27 bp, Artificial Sequence
  Synthetic oligonucleotide
aaacatcatcatccaggactgtatgtg

SEQ ID NO: 850 - DNA, 27 bp, Artificial Sequence
  Synthetic oligonucleotide
aacatcatcatccaggactgtatgtgg

SEQ ID NO: 851 - DNA, 27 bp, Artificial Sequence
  Synthetic oligonucleotide
acatcatcatccaggactgtatgtgga

SEQ ID NO: 852 - DNA, 27 bp, Artificial Sequence
  Synthetic oligonucleotide
catcatcatccaggactgtatgtggag

SEQ ID NO: 853 - DNA, 27 bp, Artificial Sequence
  Synthetic oligonucleotide
atcatcatccaggactgtatgtggagc

SEQ ID NO: 854 - DNA, 27 bp, Artificial Sequence
  Synthetic oligonucleotide
tcatcatccaggactgtatgtggagcg

SEQ ID NO: 855 - DNA, 27 bp, Artificial Sequence
  Synthetic oligonucleotide
catcatccaggactgtatgtggagcgg

SEQ ID NO: 856 - DNA, 27 bp, Artificial Sequence
  Synthetic oligonucleotide
atcatccaggactgtatgtggagcggc

SEQ ID NO: 857 - DNA, 27 bp, Artificial Sequence
  Synthetic oligonucleotide
tcatccaggactgtatgtggagcggct

SEQ ID NO: 858 - DNA, 27 bp, Artificial Sequence
  Synthetic oligonucleotide
catccaggactgtatgtggagcggctt

SEQ ID NO: 859 - DNA, 27 bp, Artificial Sequence
  Synthetic oligonucleotide
atccaggactgtatgtggagcggcttc

SEQ ID NO: 860 - DNA, 27 bp, Artificial Sequence
  Synthetic oligonucleotide
tccaggactgtatgtggagcggcttct

SEQ ID NO: 861 - DNA, 27 bp, Artificial Sequence
  Synthetic oligonucleotide
ccaggactgtatgtggagcggcttctc

SEQ ID NO: 862 - DNA, 27 bp, Artificial Sequence
  Synthetic oligonucleotide
cagagaagctggcctcctaccaggctg

SEQ ID NO: 863 - DNA, 27 bp, Artificial Sequence
  Synthetic oligonucleotide
agagaagctggcctcctaccaggctgc

SEQ ID NO: 864 - DNA, 27 bp, Artificial Sequence
  Synthetic oligonucleotide
gagaagctggcctcctaccaggctgcg

SEQ ID NO: 865 - DNA, 27 bp, Artificial Sequence
  Synthetic oligonucleotide
agaagctggcctcctaccaggctgcgc

SEQ ID NO: 866 - DNA, 27 bp, Artificial Sequence
  Synthetic oligonucleotide
gaagctggcctcctaccaggctgcgcg

SEQ ID NO: 867 - DNA, 27 bp, Artificial Sequence
  Synthetic oligonucleotide
aagctggcctcctaccaggctgcgcgc

SEQ ID NO: 868 - DNA, 27 bp, Artificial Sequence
  Synthetic oligonucleotide
agctggcctcctaccaggctgcgcgca

SEQ ID NO: 869 - DNA, 27 bp, Artificial Sequence
  Synthetic oligonucleotide
gctggcctcctaccaggctgcgcgcaa

SEQ ID NO: 870 - DNA, 27 bp, Artificial Sequence
  Synthetic oligonucleotide
ctggcctcctaccaggctgcgcgcaaa

SEQ ID NO: 871 - DNA, 27 bp, Artificial Sequence
  Synthetic oligonucleotide
tggcctcctaccaggctgcgcgcaaag

SEQ ID NO: 872 - DNA, 27 bp, Artificial Sequence
  Synthetic oligonucleotide
ggcctcctaccaggctgcgcgcaaaga

SEQ ID NO: 873 - DNA, 27 bp, Artificial Sequence
  Synthetic oligonucleotide
gcctcctaccaggctgcgcgcaaagac

SEQ ID NO: 874 - DNA, 27 bp, Artificial Sequence
  Synthetic oligonucleotide
cctcctaccaggctgcgcgcaaagaca

SEQ ID NO: 875 - DNA, 27 bp, Artificial Sequence
  Synthetic oligonucleotide
ctcctaccaggctgcgcgcaaagacag

SEQ ID NO: 876 - DNA, 27 bp, Artificial Sequence
  Synthetic oligonucleotide
tcctaccaggctgcgcgcaaagacagc

SEQ ID NO: 877 - DNA, 27 bp, Artificial Sequence
  Synthetic oligonucleotide
cctaccaggctgcgcgcaaagacagcg

SEQ ID NO: 878 - DNA, 27 bp, Artificial Sequence
  Synthetic oligonucleotide
ctaccaggctgcgcgcaaagacagcgg

SEQ ID NO: 879 - DNA, 27 bp, Artificial Sequence
  Synthetic oligonucleotide
taccaggctgcgcgcaaagacagcggc

SEQ ID NO: 880 - DNA, 27 bp, Artificial Sequence
  Synthetic oligonucleotide
accaggctgcgcgcaaagacagcggca

SEQ ID NO: 881 - DNA, 27 bp, Artificial Sequence
  Synthetic oligonucleotide
ccaggctgcgcgcaaagacagcggcag

SEQ ID NO: 882 - DNA, 27 bp, Artificial Sequence
  Synthetic oligonucleotide
caggctgcgcgcaaagacagcggcagc

SEQ ID NO: 883 - DNA, 27 bp, Artificial Sequence
  Synthetic oligonucleotide
gccacagcgtctgctccacctccagct

SEQ ID NO: 884 - DNA, 27 bp, Artificial Sequence
  Synthetic oligonucleotide
ccacagcgtctgctccacctccagctt

SEQ ID NO: 885 - DNA, 27 bp, Artificial Sequence
  Synthetic oligonucleotide
cacagcgtctgctccacctccagcttg

SEQ ID NO: 886 - DNA, 27 bp, Artificial Sequence
  Synthetic oligonucleotide
acagcgtctgctccacctccagcttgt

SEQ ID NO: 887 - DNA, 27 bp, Artificial Sequence
  Synthetic oligonucleotide
cagcgtctgctccacctccagcttgta

SEQ ID NO: 888 - DNA, 27 bp, Artificial Sequence
  Synthetic oligonucleotide
agcgtctgctccacctccagcttgtac

SEQ ID NO: 889 - DNA, 27 bp, Artificial Sequence
  Synthetic oligonucleotide
ctctcaacgacagcagctcgcccaagt

SEQ ID NO: 890 - DNA, 27 bp, Artificial Sequence
  Synthetic oligonucleotide
tctcaacgacagcagctcgcccaagtc

SEQ ID NO: 891 - DNA, 27 bp, Artificial Sequence
  Synthetic oligonucleotide
ctcaacgacagcagctcgcccaagtcc

SEQ ID NO: 892 - DNA, 27 bp, Artificial Sequence
  Synthetic oligonucleotide
tcaacgacagcagctcgcccaagtcct

SEQ ID NO: 893 - DNA, 27 bp, Artificial Sequence
  Synthetic oligonucleotide
caacgacagcagctcgcccaagtcctg

SEQ ID NO: 894 - DNA, 27 bp, Artificial Sequence
  Synthetic oligonucleotide
tccatgaggagacaccgcccaccacca

SEQ ID NO: 895 - DNA, 27 bp, Artificial Sequence
  Synthetic oligonucleotide
ccatgaggagacaccgcccaccaccag

SEQ ID NO: 896 - DNA, 27 bp, Artificial Sequence
  Synthetic oligonucleotide
catgaggagacaccgcccaccaccagc

SEQ ID NO: 897 - DNA, 27 bp, Artificial Sequence
  Synthetic oligonucleotide
atgaggagacaccgcccaccaccagca

SEQ ID NO: 898 - DNA, 27 bp, Artificial Sequence
  Synthetic oligonucleotide
tgaggagacaccgcccaccaccagcag

SEQ ID NO: 899 - DNA, 27 bp, Artificial Sequence
  Synthetic oligonucleotide
gaggagacaccgcccaccaccagcagc

SEQ ID NO: 900 - DNA, 27 bp, Artificial Sequence
  Synthetic oligonucleotide
aggagacaccgcccaccaccagcagcg

SEQ ID NO: 901 - DNA, 27 bp, Artificial Sequence
  Synthetic oligonucleotide
ggagacaccgcccaccaccagcagcga

SEQ ID NO: 902 - DNA, 27 bp, Artificial Sequence
  Synthetic oligonucleotide
gagacaccgcccaccaccagcagcgac

SEQ ID NO: 903 - DNA, 27 bp, Artificial Sequence
  Synthetic oligonucleotide
agacaccgcccaccaccagcagcgact

SEQ ID NO: 904 - DNA, 27 bp, Artificial Sequence
  Synthetic oligonucleotide
gacaccgcccaccaccagcagcgactc

SEQ ID NO: 905 - DNA, 27 bp, Artificial Sequence
  Synthetic oligonucleotide
acaccgcccaccaccagcagcgactct

SEQ ID NO: 906 - DNA, 27 bp, Artificial Sequence
  Synthetic oligonucleotide
caccgcccaccaccagcagcgactctg

SEQ ID NO: 907 - DNA, 27 bp, Artificial Sequence
  Synthetic oligonucleotide
accgcccaccaccagcagcgactctga

SEQ ID NO: 908 - DNA, 27 bp, Artificial Sequence
  Synthetic oligonucleotide
ccgcccaccaccagcagcgactctgag

SEQ ID NO: 909 - DNA, 27 bp, Artificial Sequence
  Synthetic oligonucleotide
cgcccaccaccagcagcgactctgagg

SEQ ID NO: 910 - DNA, 27 bp, Artificial Sequence
  Synthetic oligonucleotide
gcccaccaccagcagcgactctgagga

SEQ ID NO: 911 - DNA, 27 bp, Artificial Sequence
  Synthetic oligonucleotide
cccaccaccagcagcgactctgaggag

SEQ ID NO: 912 - DNA, 27 bp, Artificial Sequence
  Synthetic oligonucleotide
ccaccaccagcagcgactctgaggagg

SEQ ID NO: 913 - DNA, 27 bp, Artificial Sequence
  Synthetic oligonucleotide
caccaccagcagcgactctgaggagga

SEQ ID NO: 914 - DNA, 27 bp, Artificial Sequence
  Synthetic oligonucleotide
aacaagaagatgaggaagaaatcgatg

SEQ ID NO: 915 - DNA, 27 bp, Artificial Sequence
  Synthetic oligonucleotide
acaagaagatgaggaagaaatcgatgt

SEQ ID NO: 916 - DNA, 27 bp, Artificial Sequence
  Synthetic oligonucleotide
tggaggccacagcaaacctcctcacag

SEQ ID NO: 917 - DNA, 27 bp, Artificial Sequence
  Synthetic oligonucleotide
ctcacagcccactggtcctcaagaggt

SEQ ID NO: 918 - DNA, 27 bp, Artificial Sequence
  Synthetic oligonucleotide
tcacagcccactggtcctcaagaggtg

SEQ ID NO: 919 - DNA, 27 bp, Artificial Sequence
  Synthetic oligonucleotide
cacagcccactggtcctcaagaggtgc

SEQ ID NO: 920 - DNA, 27 bp, Artificial Sequence
  Synthetic oligonucleotide
acagcccactggtcctcaagaggtgcc

SEQ ID NO: 921 - DNA, 27 bp, Artificial Sequence
  Synthetic oligonucleotide
cagcccactggtcctcaagaggtgcca

SEQ ID NO: 922 - DNA, 27 bp, Artificial Sequence
  Synthetic oligonucleotide
agcccactggtcctcaagaggtgccac

SEQ ID NO: 923 - DNA, 27 bp, Artificial Sequence
  Synthetic oligonucleotide
gcccactggtcctcaagaggtgccacg

SEQ ID NO: 924 - DNA, 27 bp, Artificial Sequence
  Synthetic oligonucleotide
cccactggtcctcaagaggtgccacgt

SEQ ID NO: 925 - DNA, 27 bp, Artificial Sequence
  Synthetic oligonucleotide
ccactggtcctcaagaggtgccacgtc

SEQ ID NO: 926 - DNA, 27 bp, Artificial Sequence
  Synthetic oligonucleotide
cactggtcctcaagaggtgccacgtct

SEQ ID NO: 927 - DNA, 27 bp, Artificial Sequence
  Synthetic oligonucleotide
actggtcctcaagaggtgccacgtctc

SEQ ID NO: 928 - DNA, 27 bp, Artificial Sequence
  Synthetic oligonucleotide
ctggtcctcaagaggtgccacgtctcc

SEQ ID NO: 929 - DNA, 27 bp, Artificial Sequence
  Synthetic oligonucleotide
tggtcctcaagaggtgccacgtctcca

SEQ ID NO: 930 - DNA, 27 bp, Artificial Sequence
  Synthetic oligonucleotide
ggtcctcaagaggtgccacgtctccac

SEQ ID NO: 931 - DNA, 27 bp, Artificial Sequence
  Synthetic oligonucleotide
gtcctcaagaggtgccacgtctccaca

SEQ ID NO: 932 - DNA, 27 bp, Artificial Sequence
  Synthetic oligonucleotide
tcctcaagaggtgccacgtctccacac

SEQ ID NO: 933 - DNA, 27 bp, Artificial Sequence
  Synthetic oligonucleotide
ggagcttttttgccctgcgtgaccaga

SEQ ID NO: 934 - DNA, 27 bp, Artificial Sequence
  Synthetic oligonucleotide
gagcttttttgccctgcgtgaccagat

SEQ ID NO: 935 - DNA, 27 bp, Artificial Sequence
  Synthetic oligonucleotide
agcttttttgccctgcgtgaccagatc

SEQ ID NO: 936 - DNA, 27 bp, Artificial Sequence
  Synthetic oligonucleotide
gcttttttgccctgcgtgaccagatcc

SEQ ID NO: 937 - DNA, 27 bp, Artificial Sequence
  Synthetic oligonucleotide
cttttttgccctgcgtgaccagatccc

SEQ ID NO: 938 - DNA, 27 bp, Artificial Sequence
  Synthetic oligonucleotide
ttttttgccctgcgtgaccagatcccg

SEQ ID NO: 939 - DNA, 27 bp, Artificial Sequence
  Synthetic oligonucleotide
tttttgccctgcgtgaccagatcccgg

SEQ ID NO: 940 - DNA, 27 bp, Artificial Sequence
  Synthetic oligonucleotide
ttttgccctgcgtgaccagatcccgga

SEQ ID NO: 941 - DNA, 27 bp, Artificial Sequence
  Synthetic oligonucleotide
tttgccctgcgtgaccagatcccggag

SEQ ID NO: 942 - DNA, 27 bp, Artificial Sequence
  Synthetic oligonucleotide
ttgccctgcgtgaccagatcccggagt

SEQ ID NO: 943 - DNA, 27 bp, Artificial Sequence
  Synthetic oligonucleotide
tgccctgcgtgaccagatcccggagtt

SEQ ID NO: 944 - DNA, 27 bp, Artificial Sequence
  Synthetic oligonucleotide
gcggaaacgacgagaacagttgaaaca

SEQ ID NO: 945 - DNA, 27 bp, Artificial Sequence
  Synthetic oligonucleotide
cggaaacgacgagaacagttgaaacac

SEQ ID NO: 946 - DNA, 27 bp, Artificial Sequence
  Synthetic oligonucleotide
tctttaacagatttgtatttaagaatt

SEQ ID NO: 947 - DNA, 27 bp, Artificial Sequence
  Synthetic oligonucleotide
ctttaacagatttgtatttaagaattg

SEQ ID NO: 948 - DNA, 27 bp, Artificial Sequence
  Synthetic oligonucleotide
ttaaatgtaaataactttaataaaacg

SEQ ID NO: 949 - DNA, 27 bp, Artificial Sequence
  Synthetic oligonucleotide
taaatgtaaataactttaataaaacgt

SEQ ID NO: 950 - DNA, 27 bp, Artificial Sequence
  Synthetic oligonucleotide
aaatgtaaataactttaataaaacgtt

SEQ ID NO: 951 - DNA, 27 bp, Artificial Sequence
  Synthetic oligonucleotide
aatgtaaataactttaataaaacgttt

SEQ ID NO: 952 - DNA, 27 bp, Artificial Sequence
  Synthetic oligonucleotide
atgtaaataactttaataaaacgttta

SEQ ID NO: 953 - DNA, 27 bp, Artificial Sequence
  Synthetic oligonucleotide
tgtaaataactttaataaaacgtttat

SEQ ID NO: 954 - DNA, 27 bp, Artificial Sequence
  Synthetic oligonucleotide
gtaaataactttaataaaacgtttata

SEQ ID NO: 955 - DNA, 27 bp, Artificial Sequence
  Synthetic oligonucleotide
taaataactttaataaaacgtttatag

SEQ ID NO: 956 - DNA, 27 bp, Artificial Sequence
  Synthetic oligonucleotide
aaataactttaataaaacgtttatagc

SEQ ID NO: 957 - DNA, 27 bp, Artificial Sequence
  Synthetic oligonucleotide
aataactttaataaaacgtttatagca

SEQ ID NO: 958 - DNA, 27 bp, Artificial Sequence
  Synthetic oligonucleotide
ataactttaataaaacgtttatagcag

SEQ ID NO: 959 - DNA, 27 bp, Artificial Sequence
  Synthetic oligonucleotide
taactttaataaaacgtttatagcagt

SEQ ID NO: 960 - DNA, 27 bp, Artificial Sequence
  Synthetic oligonucleotide
aactttaataaaacgtttatagcagtt

SEQ ID NO: 961 - DNA, 27 bp, Artificial Sequence
  Synthetic oligonucleotide
gctttttaaagttgatttttttctatt

SEQ ID NO: 962 - DNA, 27 bp, Artificial Sequence
  Synthetic oligonucleotide
ctttttaaagttgatttttttctattg

SEQ ID NO: 963 - DNA, 27 bp, Artificial Sequence
  Synthetic oligonucleotide
tttttaaagttgatttttttctattgt

SEQ ID NO: 964 - DNA, 27 bp, Artificial Sequence
  Synthetic oligonucleotide
ttttaaagttgatttttttctattgtt

SEQ ID NO: 965 - DNA, 27 bp, Artificial Sequence
  Synthetic oligonucleotide
tttaaagttgatttttttctattgttt

SEQ ID NO: 966 - DNA, 27 bp, Artificial Sequence
  Synthetic oligonucleotide
ttaaagttgatttttttctattgtttt

SEQ ID NO: 967 - DNA, 27 bp, Artificial Sequence
  Synthetic oligonucleotide
taaagttgatttttttctattgttttt

SEQ ID NO: 968 - DNA, 27 bp, Artificial Sequence
  Synthetic oligonucleotide
aaagttgatttttttctattgttttta

SEQ ID NO: 969 - DNA, 27 bp, Artificial Sequence
  Synthetic oligonucleotide
aagttgatttttttctattgtttttag

SEQ ID NO: 970 - DNA, 27 bp, Artificial Sequence
  Synthetic oligonucleotide
agttgatttttttctattgtttttaga

SEQ ID NO: 971 - DNA, 27 bp, Artificial Sequence
  Synthetic oligonucleotide
gttgatttttttctattgtttttagaa

SEQ ID NO: 972 - DNA, 27 bp, Artificial Sequence
  Synthetic oligonucleotide
ttgatttttttctattgtttttagaaa

SEQ ID NO: 973 - DNA, 27 bp, Artificial Sequence
  Synthetic oligonucleotide
tgatttttttctattgtttttagaaaa

SEQ ID NO: 974 - DNA, 27 bp, Artificial Sequence
  Synthetic oligonucleotide
gatttttttctattgtttttagaaaaa

SEQ ID NO: 975 - DNA, 27 bp, Artificial Sequence
  Synthetic oligonucleotide
atttttttctattgtttttagaaaaaa

SEQ ID NO: 976 - DNA, 27 bp, Artificial Sequence
  Synthetic oligonucleotide
tttttttctattgtttttagaaaaaat

SEQ ID NO: 977 - DNA, 27 bp, Artificial Sequence
  Synthetic oligonucleotide
ttttttctattgtttttagaaaaaata

SEQ ID NO: 978 - DNA, 27 bp, Artificial Sequence
  Synthetic oligonucleotide
tttttctattgtttttagaaaaaataa

SEQ ID NO: 979 - DNA, 27 bp, Artificial Sequence
  Synthetic oligonucleotide
ttttctattgtttttagaaaaaataaa

SEQ ID NO: 980 - DNA, 27 bp, Artificial Sequence
  Synthetic oligonucleotide
tttctattgtttttagaaaaaataaaa

SEQ ID NO: 981 - DNA, 27 bp, Artificial Sequence
  Synthetic oligonucleotide
ttctattgtttttagaaaaaataaaat

SEQ ID NO: 982 - RNA, 25 nt, Artificial Sequence
  Synthetic oligonucleotide
cgagaagggcagggcuucucagagg

SEQ ID NO: 983 - RNA, 25 nt, Artificial Sequence
  Synthetic oligonucleotide
gcuuuaucuaacucgcuguaguaau

SEQ ID NO: 984 - RNA, 25 nt, Artificial Sequence
  Synthetic oligonucleotide
cccuugccgcauccacgaaacuuug

SEQ ID NO: 985 - RNA, 25 nt, Artificial Sequence
  Synthetic oligonucleotide
gccgcauccacgaaacuuugcccau

SEQ ID NO: 986 - RNA, 25 nt, Artificial Sequence
  Synthetic oligonucleotide
uccacgaaacuuugcccauagcagc

SEQ ID NO: 987 - RNA, 25 nt, Artificial Sequence
  Synthetic oligonucleotide
gcgggcacuuugcacuggaacuuac

SEQ ID NO: 988 - RNA, 25 nt, Artificial Sequence
  Synthetic oligonucleotide
acuuugcacuggaacuuacaacacc

SEQ ID NO: 989 - RNA, 25 nt, Artificial Sequence
  Synthetic oligonucleotide
cuggaacuuacaacacccgagcaag

SEQ ID NO: 990 - RNA, 25 nt, Artificial Sequence
  Synthetic oligonucleotide
gcagcugcuuagacgcuggauuuuu

SEQ ID NO: 991 - RNA, 25 nt, Artificial Sequence
  Synthetic oligonucleotide
gcuuagacgcuggauuuuuuucggg

SEQ ID NO: 992 - RNA, 25 nt, Artificial Sequence
  Synthetic oligonucleotide
cgcuggauuuuuuucggguagugga

SEQ ID NO: 993 - RNA, 25 nt, Artificial Sequence
  Synthetic oligonucleotide
gauuuuuuucggguaguggaaaacc

SEQ ID NO: 994 - RNA, 25 nt, Artificial Sequence
  Synthetic oligonucleotide
cggguaguggaaaaccagcagccuc

SEQ ID NO: 995 - RNA, 25 nt, Artificial Sequence
  Synthetic oligonucleotide
cucaacguuagcuucaccaacagga

SEQ ID NO: 996 - RNA, 25 nt, Artificial Sequence
  Synthetic oligonucleotide
guuagcuucaccaacaggaacuaug

SEQ ID NO: 997 - RNA, 25 nt, Artificial Sequence
  Synthetic oligonucleotide
gacucggugcagccguauuucuacu

SEQ ID NO: 998 - RNA, 25 nt, Artificial Sequence
  Synthetic oligonucleotide
gcagccguauuucuacugcgacgag

SEQ ID NO: 999 - RNA, 25 nt, Artificial Sequence
  Synthetic oligonucleotide
gaggagaacuucuaccagcagcagc

SEQ ID NO: 1000 - RNA, 25 nt, Artificial Sequence
  Synthetic oligonucleotide
gcgaggauaucuggaagaaauucga

SEQ ID NO: 1001 - RNA, 25 nt, Artificial Sequence
  Synthetic oligonucleotide
cguugcggucacacccuucucccuu

SEQ ID NO: 1002 - RNA, 25 nt, Artificial Sequence
  Synthetic oligonucleotide
acauggugaaccagaguuucaucug

SEQ ID NO: 1003 - RNA, 25 nt, Artificial Sequence
  Synthetic oligonucleotide
ccggacgacgagaccuucaucaaaa

SEQ ID NO: 1004 - RNA, 25 nt, Artificial Sequence
  Synthetic oligonucleotide
gagaccuucaucaaaaacaucauca

SEQ ID NO: 1005 - RNA, 25 nt, Artificial Sequence
  Synthetic oligonucleotide
aaaaacaucaucauccaggacugua

SEQ ID NO: 1006 - RNA, 25 nt, Artificial Sequence
  Synthetic oligonucleotide
ggacuguauguggagcggcuucucg

SEQ ID NO: 1007 - RNA, 25 nt, Artificial Sequence
  Synthetic oligonucleotide
cugcuccaccuccagcuuguaccug

SEQ ID NO: 1008 - RNA, 25 nt, Artificial Sequence
  Synthetic oligonucleotide
accuccagcuuguaccugcaggauc

SEQ ID NO: 1009 - RNA, 25 nt, Artificial Sequence
  Synthetic oligonucleotide
cagcuuguaccugcaggaucugagc

SEQ ID NO: 1010 - RNA, 25 nt, Artificial Sequence
  Synthetic oligonucleotide
aaguccugcgccucgcaagacucca

SEQ ID NO: 1011 - RNA, 25 nt, Artificial Sequence
  Synthetic oligonucleotide
gcagcgacucugaggaggaacaaga

SEQ ID NO: 1012 - RNA, 25 nt, Artificial Sequence
  Synthetic oligonucleotide
acucugaggaggaacaagaagauga

SEQ ID NO: 1013 - RNA, 25 nt, Artificial Sequence
  Synthetic oligonucleotide
gaggaggaacaagaagaugaggaag

SEQ ID NO: 1014 - RNA, 25 nt, Artificial Sequence
  Synthetic oligonucleotide
aacaagaagaugaggaagaaaucga

SEQ ID NO: 1015 - RNA, 25 nt, Artificial Sequence
  Synthetic oligonucleotide
aagaugaggaagaaaucgauguugu

SEQ ID NO: 1016 - RNA, 25 nt, Artificial Sequence
  Synthetic oligonucleotide
aggaagaaaucgauguuguuucugu

SEQ ID NO: 1017 - RNA, 25 nt, Artificial Sequence
  Synthetic oligonucleotide
aaaucgauguuguuucuguggaaaa

SEQ ID NO: 1018 - RNA, 25 nt, Artificial Sequence
  Synthetic oligonucleotide
auguuguuucuguggaaaagaggca

SEQ ID NO: 1019 - RNA, 25 nt, Artificial Sequence
  Synthetic oligonucleotide
gaggcaggcuccuggcaaaagguca

SEQ ID NO: 1020 - RNA, 25 nt, Artificial Sequence
  Synthetic oligonucleotide
aggcuccuggcaaaaggucagaguc

SEQ ID NO: 1021 - RNA, 25 nt, Artificial Sequence
  Synthetic oligonucleotide
ccuggcaaaaggucagagucuggau

SEQ ID NO: 1022 - RNA, 25 nt, Artificial Sequence
  Synthetic oligonucleotide
caaaaggucagagucuggaucaccu

SEQ ID NO: 1023 - RNA, 25 nt, Artificial Sequence
  Synthetic oligonucleotide
ggucagagucuggaucaccuucugc

SEQ ID NO: 1024 - RNA, 25 nt, Artificial Sequence
  Synthetic oligonucleotide
gcaaaccuccucacagcccacuggu

SEQ ID NO: 1025 - RNA, 25 nt, Artificial Sequence
  Synthetic oligonucleotide
ccucacagcccacugguccucaaga

SEQ ID NO: 1026 - RNA, 25 nt, Artificial Sequence
  Synthetic oligonucleotide
cccuccacucggaaggacuauccug

SEQ ID NO: 1027 - RNA, 25 nt, Artificial Sequence
  Synthetic oligonucleotide
cucggaaggacuauccugcugccaa

SEQ ID NO: 1028 - RNA, 25 nt, Artificial Sequence
  Synthetic oligonucleotide
auccugcugccaagagggucaaguu

SEQ ID NO: 1029 - RNA, 25 nt, Artificial Sequence
  Synthetic oligonucleotide
gcugccaagagggucaaguuggaca

SEQ ID NO: 1030 - RNA, 25 nt, Artificial Sequence
  Synthetic oligonucleotide
caagagggucaaguuggacaguguc

SEQ ID NO: 1031 - RNA, 25 nt, Artificial Sequence
  Synthetic oligonucleotide
gggucaaguuggacagugucagagu

SEQ ID NO: 1032 - RNA, 25 nt, Artificial Sequence
  Synthetic oligonucleotide
aaguuggacagugucagaguccuga

SEQ ID NO: 1033 - RNA, 25 nt, Artificial Sequence
  Synthetic oligonucleotide
ggacagugucagaguccugagacag

SEQ ID NO: 1034 - RNA, 25 nt, Artificial Sequence
  Synthetic oligonucleotide
cagaguccugagacagaucagcaac

SEQ ID NO: 1035 - RNA, 25 nt, Artificial Sequence
  Synthetic oligonucleotide
gagacagaucagcaacaaccgaaaa

SEQ ID NO: 1036 - RNA, 25 nt, Artificial Sequence
  Synthetic oligonucleotide
gaucagcaacaaccgaaaaugcacc

SEQ ID NO: 1037 - RNA, 25 nt, Artificial Sequence
  Synthetic oligonucleotide
ccucggacaccgaggagaaugucaa

SEQ ID NO: 1038 - RNA, 25 nt, Artificial Sequence
  Synthetic oligonucleotide
gacaccgaggagaaugucaagaggc

SEQ ID NO: 1039 - RNA, 25 nt, Artificial Sequence
  Synthetic oligonucleotide
cagaggaggaacgagcuaaaacgga

SEQ ID NO: 1040 - RNA, 25 nt, Artificial Sequence
  Synthetic oligonucleotide
aggaacgagcuaaaacggagcuuuu

SEQ ID NO: 1041 - RNA, 25 nt, Artificial Sequence
  Synthetic oligonucleotide
cgagcuaaaacggagcuuuuuugcc

SEQ ID NO: 1042 - RNA, 25 nt, Artificial Sequence
  Synthetic oligonucleotide
aaaacggagcuuuuuugcccugcgu

SEQ ID NO: 1043 - RNA, 25 nt, Artificial Sequence
  Synthetic oligonucleotide
ggagcuuuuuugcccugcgugacca

SEQ ID NO: 1044 - RNA, 25 nt, Artificial Sequence
  Synthetic oligonucleotide
gaccagaucccggaguuggaaaaca

SEQ ID NO: 1045 - RNA, 25 nt, Artificial Sequence
  Synthetic oligonucleotide
gaucccggaguuggaaaacaaugaa

SEQ ID NO: 1046 - RNA, 25 nt, Artificial Sequence
  Synthetic oligonucleotide
cggaguuggaaaacaaugaaaaggc

SEQ ID NO: 1047 - RNA, 25 nt, Artificial Sequence
  Synthetic oligonucleotide
agguaguuauccuuaaaaaagccac

SEQ ID NO: 1048 - RNA, 25 nt, Artificial Sequence
  Synthetic oligonucleotide
guuauccuuaaaaaagccacagcau

SEQ ID NO: 1049 - RNA, 25 nt, Artificial Sequence
  Synthetic oligonucleotide
ccuuaaaaaagccacagcauacauc

SEQ ID NO: 1050 - RNA, 25 nt, Artificial Sequence
  Synthetic oligonucleotide
aaaaagccacagcauacauccuguc

SEQ ID NO: 1051 - RNA, 25 nt, Artificial Sequence
  Synthetic oligonucleotide
gccacagcauacauccuguccgucc

SEQ ID NO: 1052 - RNA, 25 nt, Artificial Sequence
  Synthetic oligonucleotide
gcauacauccuguccguccaagcag

SEQ ID NO: 1053 - RNA, 25 nt, Artificial Sequence
  Synthetic oligonucleotide
ccuguccguccaagcagaggagcaa

SEQ ID NO: 1054 - RNA, 25 nt, Artificial Sequence
  Synthetic oligonucleotide
ccguccaagcagaggagcaaaagcu

SEQ ID NO: 1055 - RNA, 25 nt, Artificial Sequence
  Synthetic oligonucleotide
gcagaggagcaaaagcucauuucug

SEQ ID NO: 1056 - RNA, 25 nt, Artificial Sequence
  Synthetic oligonucleotide
agcaaaagcucauuucugaagagga

SEQ ID NO: 1057 - RNA, 25 nt, Artificial Sequence
  Synthetic oligonucleotide
aagcucauuucugaagaggacuugu

SEQ ID NO: 1058 - RNA, 25 nt, Artificial Sequence
  Synthetic oligonucleotide
auuucugaagaggacuuguugcgga

SEQ ID NO: 1059 - RNA, 25 nt, Artificial Sequence
  Synthetic oligonucleotide
gaagaggacuuguugcggaaacgac

SEQ ID NO: 1060 - RNA, 25 nt, Artificial Sequence
  Synthetic oligonucleotide
ggacuuguugcggaaacgacgagaa

SEQ ID NO: 1061 - RNA, 25 nt, Artificial Sequence
  Synthetic oligonucleotide
uguugcggaaacgacgagaacaguu

SEQ ID NO: 1062 - RNA, 25 nt, Artificial Sequence
  Synthetic oligonucleotide
cggaaacgacgagaacaguugaaac

SEQ ID NO: 1063 - RNA, 25 nt, Artificial Sequence
  Synthetic oligonucleotide
aaacuugaacagcuacggaacucuu

SEQ ID NO: 1064 - RNA, 25 nt, Artificial Sequence
  Synthetic oligonucleotide
gaacagcuacggaacucuugugcgu

SEQ ID NO: 1065 - RNA, 25 nt, Artificial Sequence
  Synthetic oligonucleotide
gcuacggaacucuugugcguaagga

SEQ ID NO: 1066 - RNA, 25 nt, Artificial Sequence
  Synthetic oligonucleotide
aacucuugugcguaaggaaaaguaa

SEQ ID NO: 1067 - RNA, 25 nt, Artificial Sequence
  Synthetic oligonucleotide
ugugcguaaggaaaaguaaggaaaa

SEQ ID NO: 1068 - RNA, 25 nt, Artificial Sequence
  Synthetic oligonucleotide
guaaggaaaaguaaggaaaacgauu

SEQ ID NO: 1069 - RNA, 25 nt, Artificial Sequence
  Synthetic oligonucleotide
guaaggaaaacgauuccuucuaaca

SEQ ID NO: 1070 - RNA, 25 nt, Artificial Sequence
  Synthetic oligonucleotide
gaaaacgauuccuucuaacagaaau

SEQ ID NO: 1071 - RNA, 25 nt, Artificial Sequence
  Synthetic oligonucleotide
cgauuccuucuaacagaaauguccu

SEQ ID NO: 1072 - RNA, 25 nt, Artificial Sequence
  Synthetic oligonucleotide
cuucuaacagaaauguccugagcaa

SEQ ID NO: 1073 - RNA, 25 nt, Artificial Sequence
  Synthetic oligonucleotide
cagaaauguccugagcaaucaccua

SEQ ID NO: 1074 - RNA, 25 nt, Artificial Sequence
  Synthetic oligonucleotide
ccugagcaaucaccuaugaacuugu

SEQ ID NO: 1075 - RNA, 25 nt, Artificial Sequence
  Synthetic oligonucleotide
caaucaccuaugaacuuguuucaaa

SEQ ID NO: 1076 - RNA, 25 nt, Artificial Sequence
  Synthetic oligonucleotide
ccuaugaacuuguuucaaaugcaug

SEQ ID NO: 1077 - RNA, 25 nt, Artificial Sequence
  Synthetic oligonucleotide
gaacuuguuucaaaugcaugaucaa

SEQ ID NO: 1078 - RNA, 25 nt, Artificial Sequence
  Synthetic oligonucleotide
guuucaaaugcaugaucaaaugcaa

SEQ ID NO: 1079 - RNA, 25 nt, Artificial Sequence
  Synthetic oligonucleotide
aaaugcaugaucaaaugcaaccuca

SEQ ID NO: 1080 - RNA, 25 nt, Artificial Sequence
  Synthetic oligonucleotide
gaucaaaugcaaccucacaaccuug

SEQ ID NO: 1081 - RNA, 25 nt, Artificial Sequence
  Synthetic oligonucleotide
aaugcaaccucacaaccuuggcuga

SEQ ID NO: 1082 - RNA, 25 nt, Artificial Sequence
  Synthetic oligonucleotide
ccucacaaccuuggcugagucuuga

SEQ ID NO: 1083 - RNA, 25 nt, Artificial Sequence
  Synthetic oligonucleotide
caaccuuggcugagucuugagacug

SEQ ID NO: 1084 - RNA, 25 nt, Artificial Sequence
  Synthetic oligonucleotide
ggcugagucuugagacugaaagauu

SEQ ID NO: 1085 - RNA, 25 nt, Artificial Sequence
  Synthetic oligonucleotide
gucuugagacugaaagauuuagcca

SEQ ID NO: 1086 - RNA, 25 nt, Artificial Sequence
  Synthetic oligonucleotide
gacugaaagauuuagccauaaugua

SEQ ID NO: 1087 - RNA, 25 nt, Artificial Sequence
  Synthetic oligonucleotide
aaagauuuagccauaauguaaacug

SEQ ID NO: 1088 - RNA, 25 nt, Artificial Sequence
  Synthetic oligonucleotide
gccauaauguaaacugccucaaauu

SEQ ID NO: 1089 - RNA, 25 nt, Artificial Sequence
  Synthetic oligonucleotide
guaaacugccucaaauuggacuuug

SEQ ID NO: 1090 - RNA, 25 nt, Artificial Sequence
  Synthetic oligonucleotide
ugccucaaauuggacuuugggcaua

SEQ ID NO: 1091 - RNA, 25 nt, Artificial Sequence
  Synthetic oligonucleotide
caaauuggacuuugggcauaaaaga

SEQ ID NO: 1092 - RNA, 25 nt, Artificial Sequence
  Synthetic oligonucleotide
gacuuugggcauaaaagaacuuuuu

SEQ ID NO: 1093 - RNA, 25 nt, Artificial Sequence
  Synthetic oligonucleotide
ggcauaaaagaacuuuuuuaugcuu

SEQ ID NO: 1094 - RNA, 25 nt, Artificial Sequence
  Synthetic oligonucleotide
aaaagaacuuuuuuaugcuuaccau

SEQ ID NO: 1095 - RNA, 25 nt, Artificial Sequence
  Synthetic oligonucleotide
aacuuuuuuaugcuuaccaucuuuu

SEQ ID NO: 1096 - RNA, 25 nt, Artificial Sequence
  Synthetic oligonucleotide
uuuaugcuuaccaucuuuuuuuuuu

SEQ ID NO: 1097 - RNA, 25 nt, Artificial Sequence
  Synthetic oligonucleotide
gcuuaccaucuuuuuuuuuucuuua

SEQ ID NO: 1098 - RNA, 25 nt, Artificial Sequence
  Synthetic oligonucleotide
ccaucuuuuuuuuuucuuuaacaga

SEQ ID NO: 1099 - RNA, 25 nt, Artificial Sequence
  Synthetic oligonucleotide
uuuuuuuuucuuuaacagauuugua

SEQ ID NO: 1100 - RNA, 25 nt, Artificial Sequence
  Synthetic oligonucleotide
cuuuaacagauuuguauuuaagaau

SEQ ID NO: 1101 - RNA, 25 nt, Artificial Sequence
  Synthetic oligonucleotide
cagauuuguauuuaagaauuguuuu

SEQ ID NO: 1102 - RNA, 25 nt, Artificial Sequence
  Synthetic oligonucleotide
uauuuaagaauuguuuuuaaaaaau

SEQ ID NO: 1103 - RNA, 25 nt, Artificial Sequence
  Synthetic oligonucleotide
gaauuguuuuuaaaaaauuuuaaga

SEQ ID NO: 1104 - RNA, 25 nt, Artificial Sequence
  Synthetic oligonucleotide
aauguuucucuguaaauauugccau

SEQ ID NO: 1105 - RNA, 25 nt, Artificial Sequence
  Synthetic oligonucleotide
cuguaaauauugccauuaaauguaa

SEQ ID NO: 1106 - RNA, 25 nt, Artificial Sequence
  Synthetic oligonucleotide
aauauugccauuaaauguaaauaac

SEQ ID NO: 1107 - RNA, 25 nt, Artificial Sequence
  Synthetic oligonucleotide
ccauuaaauguaaauaacuuuaaua

SEQ ID NO: 1108 - RNA, 25 nt, Artificial Sequence
  Synthetic oligonucleotide
uuaauaaaacguuuauagcaguuac

SEQ ID NO: 1109 - RNA, 25 nt, Artificial Sequence
  Synthetic oligonucleotide
cagaauuucaauccuaguauauagu

SEQ ID NO: 1110 - RNA, 25 nt, Artificial Sequence
  Synthetic oligonucleotide
cuaguauuauagguacuauaaaccc

SEQ ID NO: 1111 - RNA, 25 nt, Artificial Sequence
  Synthetic oligonucleotide
uauagguacuauaaacccuaauuuu

SEQ ID NO: 1112 - RNA, 25 nt, Artificial Sequence
  Synthetic oligonucleotide
acuauaaacccuaauuuuuuuuauu

SEQ ID NO: 1113 - RNA, 25 nt, Artificial Sequence
  Synthetic oligonucleotide
cccuaauuuuuuuuauuuaaguaca

SEQ ID NO: 1114 - RNA, 25 nt, Artificial Sequence
  Synthetic oligonucleotide
auuuuuuuuauuuaaguacauuuug

SEQ ID NO: 1115 - RNA, 25 nt, Artificial Sequence
  Synthetic oligonucleotide
uauuuaaguacauuuugcuuuuuaa

SEQ ID NO: 1116 - RNA, 25 nt, Artificial Sequence
  Synthetic oligonucleotide
aaguacauuuugcuuuuuaaaguug

SEQ ID NO: 1117 - RNA, 25 nt, Artificial Sequence
  Synthetic oligonucleotide
auuuugcuuuuuaaaguugauuuuu

SEQ ID NO: 1118 - RNA, 25 nt, Artificial Sequence
  Synthetic oligonucleotide
cuuuuuaaaguugauuuuuuucuau

SEQ ID NO: 1119 - RNA, 25 nt, Artificial Sequence
  Synthetic oligonucleotide
uauuguuuuuagaaaaaauaaaaua

SEQ ID NO: 1120 - RNA, 25 nt, Artificial Sequence
  Synthetic oligonucleotide
uuuuuagaaaaaauaaaauaacugg

SEQ ID NO: 1121 - RNA, 25 nt, Artificial Sequence
  Synthetic oligonucleotide
aaaaauaaaauaacuggcaaauaua

SEQ ID NO: 1122 - RNA, 25 nt, Artificial Sequence
  Synthetic oligonucleotide
aauaacuggcaaauauaucauugag

SEQ ID NO: 1123 - RNA, 25 nt, Artificial Sequence
  Synthetic oligonucleotide
caaauauaucauugagccaaaucuu

SEQ ID NO: 1124 - RNA, 25 nt, Artificial Sequence
  Synthetic oligonucleotide
aucauugagccaaaucuuaaaaaaa

SEQ ID NO: 1125 - RNA, 25 nt, Artificial Sequence
  Synthetic oligonucleotide
gagccaaaucuuaaaaaaaaaaaaa

SEQ ID NO: 1126 - RNA, 25 nt, Artificial Sequence
  Synthetic oligonucleotide
acucgcuguaguaauuccagcgaga

SEQ ID NO: 1127 - RNA, 25 nt, Artificial Sequence
  Synthetic oligonucleotide
cucgcuguaguaauuccagcgagag

SEQ ID NO: 1128 - RNA, 25 nt, Artificial Sequence
  Synthetic oligonucleotide
ucgcuguaguaauuccagcgagagg

SEQ ID NO: 1129 - RNA, 25 nt, Artificial Sequence
  Synthetic oligonucleotide
cgcuguaguaauuccagcgagaggc

SEQ ID NO: 1130 - RNA, 25 nt, Artificial Sequence
  Synthetic oligonucleotide
gcuguaguaauuccagcgagaggca

SEQ ID NO: 1131 - RNA, 25 nt, Artificial Sequence
  Synthetic oligonucleotide
cuguaguaauuccagcgagaggcag

SEQ ID NO: 1132 - RNA, 25 nt, Artificial Sequence
  Synthetic oligonucleotide
uguaguaauuccagcgagaggcaga

SEQ ID NO: 1133 - RNA, 25 nt, Artificial Sequence
  Synthetic oligonucleotide
guaguaauuccagcgagaggcagag

SEQ ID NO: 1134 - RNA, 25 nt, Artificial Sequence
  Synthetic oligonucleotide
cuucaccaacaggaacuaugaccuc

SEQ ID NO: 1135 - RNA, 25 nt, Artificial Sequence
  Synthetic oligonucleotide
uucaccaacaggaacuaugaccucg

SEQ ID NO: 1136 - RNA, 25 nt, Artificial Sequence
  Synthetic oligonucleotide
ucaccaacaggaacuaugaccucga

SEQ ID NO: 1137 - RNA, 25 nt, Artificial Sequence
  Synthetic oligonucleotide
caccaacaggaacuaugaccucgac

SEQ ID NO: 1138 - RNA, 25 nt, Artificial Sequence
  Synthetic oligonucleotide
accaacaggaacuaugaccucgacu

SEQ ID NO: 1139 - RNA, 25 nt, Artificial Sequence
  Synthetic oligonucleotide
ccaacaggaacuaugaccucgacua

SEQ ID NO: 1140 - RNA, 25 nt, Artificial Sequence
  Synthetic oligonucleotide
caacaggaacuaugaccucgacuac

SEQ ID NO: 1141 - RNA, 25 nt, Artificial Sequence
  Synthetic oligonucleotide
aacaggaacuaugaccucgacuacg

SEQ ID NO: 1142 - RNA, 25 nt, Artificial Sequence
  Synthetic oligonucleotide
acaggaacuaugaccucgacuacga

SEQ ID NO: 1143 - RNA, 25 nt, Artificial Sequence
  Synthetic oligonucleotide
caggaacuaugaccucgacuacgac

SEQ ID NO: 1144 - RNA, 25 nt, Artificial Sequence
  Synthetic oligonucleotide
aggaacuaugaccucgacuacgacu

SEQ ID NO: 1145 - RNA, 25 nt, Artificial Sequence
  Synthetic oligonucleotide
ggaacuaugaccucgacuacgacuc

SEQ ID NO: 1146 - RNA, 25 nt, Artificial Sequence
  Synthetic oligonucleotide
gaacuaugaccucgacuacgacucg

SEQ ID NO: 1147 - RNA, 25 nt, Artificial Sequence
  Synthetic oligonucleotide
aacuaugaccucgacuacgacucgg

SEQ ID NO: 1148 - RNA, 25 nt, Artificial Sequence
  Synthetic oligonucleotide
acuaugaccucgacuacgacucggu

SEQ ID NO: 1149 - RNA, 25 nt, Artificial Sequence
  Synthetic oligonucleotide
cuaugaccucgacuacgacucggug

SEQ ID NO: 1150 - RNA, 25 nt, Artificial Sequence
  Synthetic oligonucleotide
uaugaccucgacuacgacucggugc

SEQ ID NO: 1151 - RNA, 25 nt, Artificial Sequence
  Synthetic oligonucleotide
augaccucgacuacgacucggugca

SEQ ID NO: 1152 - RNA, 25 nt, Artificial Sequence
  Synthetic oligonucleotide
gaggauaucuggaagaaauucgagc

SEQ ID NO: 1153 - RNA, 25 nt, Artificial Sequence
  Synthetic oligonucleotide
aggauaucuggaagaaauucgagcu

SEQ ID NO: 1154 - RNA, 25 nt, Artificial Sequence
  Synthetic oligonucleotide
ggauaucuggaagaaauucgagcug

SEQ ID NO: 1155 - RNA, 25 nt, Artificial Sequence
  Synthetic oligonucleotide
gauaucuggaagaaauucgagcugc

SEQ ID NO: 1156 - RNA, 25 nt, Artificial Sequence
  Synthetic oligonucleotide
auaucuggaagaaauucgagcugcu

SEQ ID NO: 1157 - RNA, 25 nt, Artificial Sequence
  Synthetic oligonucleotide
uaucuggaagaaauucgagcugcug

SEQ ID NO: 1158 - RNA, 25 nt, Artificial Sequence
  Synthetic oligonucleotide
aucuggaagaaauucgagcugcugc

SEQ ID NO: 1159 - RNA, 25 nt, Artificial Sequence
  Synthetic oligonucleotide
ucuggaagaaauucgagcugcugcc

SEQ ID NO: 1160 - RNA, 25 nt, Artificial Sequence
  Synthetic oligonucleotide
cuggaagaaauucgagcugcugccc

SEQ ID NO: 1161 - RNA, 25 nt, Artificial Sequence
  Synthetic oligonucleotide
uggaagaaauucgagcugcugccca

SEQ ID NO: 1162 - RNA, 25 nt, Artificial Sequence
  Synthetic oligonucleotide
ggaagaaauucgagcugcugcccac

SEQ ID NO: 1163 - RNA, 25 nt, Artificial Sequence
  Synthetic oligonucleotide
agccgccgcuccgggcucugcucgc

SEQ ID NO: 1164 - RNA, 25 nt, Artificial Sequence
  Synthetic oligonucleotide
gccgccgcuccgggcucugcucgcc

SEQ ID NO: 1165 - RNA, 25 nt, Artificial Sequence
  Synthetic oligonucleotide
ccgccgcuccgggcucugcucgccc

SEQ ID NO: 1166 - RNA, 25 nt, Artificial Sequence
  Synthetic oligonucleotide
cgccgcuccgggcucugcucgcccu

SEQ ID NO: 1167 - RNA, 25 nt, Artificial Sequence
  Synthetic oligonucleotide
gccgcuccgggcucugcucgcccuc

SEQ ID NO: 1168 - RNA, 25 nt, Artificial Sequence
  Synthetic oligonucleotide
ggaggagacauggugaaccagaguu

SEQ ID NO: 1169 - RNA, 25 nt, Artificial Sequence
  Synthetic oligonucleotide
gaggagacauggugaaccagaguuu

SEQ ID NO: 1170 - RNA, 25 nt, Artificial Sequence
  Synthetic oligonucleotide
aggagacauggugaaccagaguuuc

SEQ ID NO: 1171 - RNA, 25 nt, Artificial Sequence
  Synthetic oligonucleotide
ggagacauggugaaccagaguuuca

SEQ ID NO: 1172 - RNA, 25 nt, Artificial Sequence
  Synthetic oligonucleotide
gagacauggugaaccagaguuucau

SEQ ID NO: 1173 - RNA, 25 nt, Artificial Sequence
  Synthetic oligonucleotide
gacgacgagaccuucaucaaaaaca

SEQ ID NO: 1174 - RNA, 25 nt, Artificial Sequence
  Synthetic oligonucleotide
acgacgagaccuucaucaaaaacau

SEQ ID NO: 1175 - RNA, 25 nt, Artificial Sequence
  Synthetic oligonucleotide
aacaucaucauccaggacuguaugu

SEQ ID NO: 1176 - RNA, 25 nt, Artificial Sequence
  Synthetic oligonucleotide
acaucaucauccaggacuguaugug

SEQ ID NO: 1177 - RNA, 25 nt, Artificial Sequence
  Synthetic oligonucleotide
caucaucauccaggacuguaugugg

SEQ ID NO: 1178 - RNA, 25 nt, Artificial Sequence
  Synthetic oligonucleotide
aucaucauccaggacuguaugugga

SEQ ID NO: 1179 - RNA, 25 nt, Artificial Sequence
  Synthetic oligonucleotide
ucaucauccaggacuguauguggag

SEQ ID NO: 1180 - RNA, 25 nt, Artificial Sequence
  Synthetic oligonucleotide
caucauccaggacuguauguggagc

SEQ ID NO: 1181 - RNA, 25 nt, Artificial Sequence
  Synthetic oligonucleotide
aucauccaggacuguauguggagcg

SEQ ID NO: 1182 - RNA, 25 nt, Artificial Sequence
  Synthetic oligonucleotide
ucauccaggacuguauguggagcgg

SEQ ID NO: 1183 - RNA, 25 nt, Artificial Sequence
  Synthetic oligonucleotide
cauccaggacuguauguggagcggc

SEQ ID NO: 1184 - RNA, 25 nt, Artificial Sequence
  Synthetic oligonucleotide
auccaggacuguauguggagcggcu

SEQ ID NO: 1185 - RNA, 25 nt, Artificial Sequence
  Synthetic oligonucleotide
uccaggacuguauguggagcggcuu

SEQ ID NO: 1186 - RNA, 25 nt, Artificial Sequence
  Synthetic oligonucleotide
ccaggacuguauguggagcggcuuc

SEQ ID NO: 1187 - RNA, 25 nt, Artificial Sequence
  Synthetic oligonucleotide
caggacuguauguggagcggcuucu

SEQ ID NO: 1188 - RNA, 25 nt, Artificial Sequence
  Synthetic oligonucleotide
aggacuguauguggagcggcuucuc

SEQ ID NO: 1189 - RNA, 25 nt, Artificial Sequence
  Synthetic oligonucleotide
gagaagcuggccuccuaccaggcug

SEQ ID NO: 1190 - RNA, 25 nt, Artificial Sequence
  Synthetic oligonucleotide
agaagcuggccuccuaccaggcugc

SEQ ID NO: 1191 - RNA, 25 nt, Artificial Sequence
  Synthetic oligonucleotide
gaagcuggccuccuaccaggcugcg

SEQ ID NO: 1192 - RNA, 25 nt, Artificial Sequence
  Synthetic oligonucleotide
aagcuggccuccuaccaggcugcgc

SEQ ID NO: 1193 - RNA, 25 nt, Artificial Sequence
  Synthetic oligonucleotide
agcuggccuccuaccaggcugcgcg

SEQ ID NO: 1194 - RNA, 25 nt, Artificial Sequence
  Synthetic oligonucleotide
gcuggccuccuaccaggcugcgcgc

SEQ ID NO: 1195 - RNA, 25 nt, Artificial Sequence
  Synthetic oligonucleotide
cuggccuccuaccaggcugcgcgca

SEQ ID NO: 1196 - RNA, 25 nt, Artificial Sequence
  Synthetic oligonucleotide
uggccuccuaccaggcugcgcgcaa

SEQ ID NO: 1197 - RNA, 25 nt, Artificial Sequence
  Synthetic oligonucleotide
ggccuccuaccaggcugcgcgcaaa

SEQ ID NO: 1198 - RNA, 25 nt, Artificial Sequence
  Synthetic oligonucleotide
gccuccuaccaggcugcgcgcaaag

SEQ ID NO: 1199 - RNA, 25 nt, Artificial Sequence
  Synthetic oligonucleotide
ccuccuaccaggcugcgcgcaaaga

SEQ ID NO: 1200 - RNA, 25 nt, Artificial Sequence
  Synthetic oligonucleotide
cuccuaccaggcugcgcgcaaagac

SEQ ID NO: 1201 - RNA, 25 nt, Artificial Sequence
  Synthetic oligonucleotide
uccuaccaggcugcgcgcaaagaca

SEQ ID NO: 1202 - RNA, 25 nt, Artificial Sequence
  Synthetic oligonucleotide
ccuaccaggcugcgcgcaaagacag

SEQ ID NO: 1203 - RNA, 25 nt, Artificial Sequence
  Synthetic oligonucleotide
cuaccaggcugcgcgcaaagacagc

SEQ ID NO: 1204 - RNA, 25 nt, Artificial Sequence
  Synthetic oligonucleotide
uaccaggcugcgcgcaaagacagcg

SEQ ID NO: 1205 - RNA, 25 nt, Artificial Sequence
  Synthetic oligonucleotide
accaggcugcgcgcaaagacagcgg

SEQ ID NO: 1206 - RNA, 25 nt, Artificial Sequence
  Synthetic oligonucleotide
ccaggcugcgcgcaaagacagcggc

SEQ ID NO: 1207 - RNA, 25 nt, Artificial Sequence
  Synthetic oligonucleotide
caggcugcgcgcaaagacagcggca

SEQ ID NO: 1208 - RNA, 25 nt, Artificial Sequence
  Synthetic oligonucleotide
aggcugcgcgcaaagacagcggcag

SEQ ID NO: 1209 - RNA, 25 nt, Artificial Sequence
  Synthetic oligonucleotide
ggcugcgcgcaaagacagcggcagc

SEQ ID NO: 1210 - RNA, 25 nt, Artificial Sequence
  Synthetic oligonucleotide
cacagcgucugcuccaccuccagcu

SEQ ID NO: 1211 - RNA, 25 nt, Artificial Sequence
  Synthetic oligonucleotide
acagcgucugcuccaccuccagcuu

SEQ ID NO: 1212 - RNA, 25 nt, Artificial Sequence
  Synthetic oligonucleotide
cagcgucugcuccaccuccagcuug

SEQ ID NO: 1213 - RNA, 25 nt, Artificial Sequence
  Synthetic oligonucleotide
agcgucugcuccaccuccagcuugu

SEQ ID NO: 1214 - RNA, 25 nt, Artificial Sequence
  Synthetic oligonucleotide
gcgucugcuccaccuccagcuugua

SEQ ID NO: 1215 - RNA, 25 nt, Artificial Sequence
  Synthetic oligonucleotide
cgucugcuccaccuccagcuuguac

SEQ ID NO: 1216 - RNA, 25 nt, Artificial Sequence
  Synthetic oligonucleotide
cucaacgacagcagcucgcccaagu

SEQ ID NO: 1217 - RNA, 25 nt, Artificial Sequence
  Synthetic oligonucleotide
ucaacgacagcagcucgcccaaguc

SEQ ID NO: 1218 - RNA, 25 nt, Artificial Sequence
  Synthetic oligonucleotide
caacgacagcagcucgcccaagucc

SEQ ID NO: 1219 - RNA, 25 nt, Artificial Sequence
  Synthetic oligonucleotide
aacgacagcagcucgcccaaguccu

SEQ ID NO: 1220 - RNA, 25 nt, Artificial Sequence
  Synthetic oligonucleotide
acgacagcagcucgcccaaguccug

SEQ ID NO: 1221 - RNA, 25 nt, Artificial Sequence
  Synthetic oligonucleotide
caugaggagacaccgcccaccacca

SEQ ID NO: 1222 - RNA, 25 nt, Artificial Sequence
  Synthetic oligonucleotide
augaggagacaccgcccaccaccag

SEQ ID NO: 1223 - RNA, 25 nt, Artificial Sequence
  Synthetic oligonucleotide
ugaggagacaccgcccaccaccagc

SEQ ID NO: 1224 - RNA, 25 nt, Artificial Sequence
  Synthetic oligonucleotide
gaggagacaccgcccaccaccagca

SEQ ID NO: 1225 - RNA, 25 nt, Artificial Sequence
  Synthetic oligonucleotide
aggagacaccgcccaccaccagcag

SEQ ID NO: 1226 - RNA, 25 nt, Artificial Sequence
  Synthetic oligonucleotide
ggagacaccgcccaccaccagcagc

SEQ ID NO: 1227 - RNA, 25 nt, Artificial Sequence
  Synthetic oligonucleotide
gagacaccgcccaccaccagcagcg

SEQ ID NO: 1228 - RNA, 25 nt, Artificial Sequence
  Synthetic oligonucleotide
agacaccgcccaccaccagcagcga

SEQ ID NO: 1229 - RNA, 25 nt, Artificial Sequence
  Synthetic oligonucleotide
gacaccgcccaccaccagcagcgac

SEQ ID NO: 1230 - RNA, 25 nt, Artificial Sequence
  Synthetic oligonucleotide
acaccgcccaccaccagcagcgacu

SEQ ID NO: 1231 - RNA, 25 nt, Artificial Sequence
  Synthetic oligonucleotide
caccgcccaccaccagcagcgacuc

SEQ ID NO: 1232 - RNA, 25 nt, Artificial Sequence
  Synthetic oligonucleotide
accgcccaccaccagcagcgacucu

SEQ ID NO: 1233 - RNA, 25 nt, Artificial Sequence
  Synthetic oligonucleotide
ccgcccaccaccagcagcgacucug

SEQ ID NO: 1234 - RNA, 25 nt, Artificial Sequence
  Synthetic oligonucleotide
cgcccaccaccagcagcgacucuga

SEQ ID NO: 1235 - RNA, 25 nt, Artificial Sequence
  Synthetic oligonucleotide
gcccaccaccagcagcgacucugag

SEQ ID NO: 1236 - RNA, 25 nt, Artificial Sequence
  Synthetic oligonucleotide
cccaccaccagcagcgacucugagg

SEQ ID NO: 1237 - RNA, 25 nt, Artificial Sequence
  Synthetic oligonucleotide
ccaccaccagcagcgacucugagga

SEQ ID NO: 1238 - RNA, 25 nt, Artificial Sequence
  Synthetic oligonucleotide
caccaccagcagcgacucugaggag

SEQ ID NO: 1239 - RNA, 25 nt, Artificial Sequence
  Synthetic oligonucleotide
accaccagcagcgacucugaggagg

SEQ ID NO: 1240 - RNA, 25 nt, Artificial Sequence
  Synthetic oligonucleotide
ccaccagcagcgacucugaggagga

SEQ ID NO: 1241 - RNA, 25 nt, Artificial Sequence
  Synthetic oligonucleotide
caagaagaugaggaagaaaucgaug

SEQ ID NO: 1242 - RNA, 25 nt, Artificial Sequence
  Synthetic oligonucleotide
aagaagaugaggaagaaaucgaugu

SEQ ID NO: 1243 - RNA, 25 nt, Artificial Sequence
  Synthetic oligonucleotide
gaggccacagcaaaccuccucacag

SEQ ID NO: 1244 - RNA, 25 nt, Artificial Sequence
  Synthetic oligonucleotide
cacagcccacugguccucaagaggu

SEQ ID NO: 1245 - RNA, 25 nt, Artificial Sequence
  Synthetic oligonucleotide
acagcccacugguccucaagaggug

SEQ ID NO: 1246 - RNA, 25 nt, Artificial Sequence
  Synthetic oligonucleotide
cagcccacugguccucaagaggugc

SEQ ID NO: 1247 - RNA, 25 nt, Artificial Sequence
  Synthetic oligonucleotide
agcccacugguccucaagaggugcc

SEQ ID NO: 1248 - RNA, 25 nt, Artificial Sequence
  Synthetic oligonucleotide
gcccacugguccucaagaggugcca

SEQ ID NO: 1249 - RNA, 25 nt, Artificial Sequence
  Synthetic oligonucleotide
cccacugguccucaagaggugccac

SEQ ID NO: 1250 - RNA, 25 nt, Artificial Sequence
  Synthetic oligonucleotide
ccacugguccucaagaggugccacg

SEQ ID NO: 1251 - RNA, 25 nt, Artificial Sequence
  Synthetic oligonucleotide
cacugguccucaagaggugccacgu

SEQ ID NO: 1252 - RNA, 25 nt, Artificial Sequence
  Synthetic oligonucleotide
acugguccucaagaggugccacguc

SEQ ID NO: 1253 - RNA, 25 nt, Artificial Sequence
  Synthetic oligonucleotide
cugguccucaagaggugccacgucu

SEQ ID NO: 1254 - RNA, 25 nt, Artificial Sequence
  Synthetic oligonucleotide
ugguccucaagaggugccacgucuc

SEQ ID NO: 1255 - RNA, 25 nt, Artificial Sequence
  Synthetic oligonucleotide
gguccucaagaggugccacgucucc

SEQ ID NO: 1256 - RNA, 25 nt, Artificial Sequence
  Synthetic oligonucleotide
guccucaagaggugccacgucucca

SEQ ID NO: 1257 - RNA, 25 nt, Artificial Sequence
  Synthetic oligonucleotide
uccucaagaggugccacgucuccac

SEQ ID NO: 1258 - RNA, 25 nt, Artificial Sequence
  Synthetic oligonucleotide
ccucaagaggugccacgucuccaca

SEQ ID NO: 1259 - RNA, 25 nt, Artificial Sequence
  Synthetic oligonucleotide
cucaagaggugccacgucuccacac

SEQ ID NO: 1260 - RNA, 25 nt, Artificial Sequence
  Synthetic oligonucleotide
agcuuuuuugcccugcgugaccaga

SEQ ID NO: 1261 - RNA, 25 nt, Artificial Sequence
  Synthetic oligonucleotide
gcuuuuuugcccugcgugaccagau

SEQ ID NO: 1262 - RNA, 25 nt, Artificial Sequence
  Synthetic oligonucleotide
cuuuuuugcccugcgugaccagauc

SEQ ID NO: 1263 - RNA, 25 nt, Artificial Sequence
  Synthetic oligonucleotide
uuuuuugcccugcgugaccagaucc

SEQ ID NO: 1264 - RNA, 25 nt, Artificial Sequence
  Synthetic oligonucleotide
uuuuugcccugcgugaccagauccc

SEQ ID NO: 1265 - RNA, 25 nt, Artificial Sequence
  Synthetic oligonucleotide
uuuugcccugcgugaccagaucccg

SEQ ID NO: 1266 - RNA, 25 nt, Artificial Sequence
  Synthetic oligonucleotide
uuugcccugcgugaccagaucccgg

SEQ ID NO: 1267 - RNA, 25 nt, Artificial Sequence
  Synthetic oligonucleotide
uugcccugcgugaccagaucccgga

SEQ ID NO: 1268 - RNA, 25 nt, Artificial Sequence
  Synthetic oligonucleotide
ugcccugcgugaccagaucccggag

SEQ ID NO: 1269 - RNA, 25 nt, Artificial Sequence
  Synthetic oligonucleotide
gcccugcgugaccagaucccggagu

SEQ ID NO: 1270 - RNA, 25 nt, Artificial Sequence
  Synthetic oligonucleotide
cccugcgugaccagaucccggaguu

SEQ ID NO: 1271 - RNA, 25 nt, Artificial Sequence
  Synthetic oligonucleotide
ggaaacgacgagaacaguugaaaca

SEQ ID NO: 1272 - RNA, 25 nt, Artificial Sequence
  Synthetic oligonucleotide
gaaacgacgagaacaguugaaacac

SEQ ID NO: 1273 - RNA, 25 nt, Artificial Sequence
  Synthetic oligonucleotide
uuuaacagauuuguauuuaagaauu

SEQ ID NO: 1274 - RNA, 25 nt, Artificial Sequence
  Synthetic oligonucleotide
uuaacagauuuguauuuaagaauug

SEQ ID NO: 1275 - RNA, 25 nt, Artificial Sequence
  Synthetic oligonucleotide
aaauguaaauaacuuuaauaaaacg

SEQ ID NO: 1276 - RNA, 25 nt, Artificial Sequence
  Synthetic oligonucleotide
aauguaaauaacuuuaauaaaacgu

SEQ ID NO: 1277 - RNA, 25 nt, Artificial Sequence
  Synthetic oligonucleotide
auguaaauaacuuuaauaaaacguu

SEQ ID NO: 1278 - RNA, 25 nt, Artificial Sequence
  Synthetic oligonucleotide
uguaaauaacuuuaauaaaacguuu

SEQ ID NO: 1279 - RNA, 25 nt, Artificial Sequence
  Synthetic oligonucleotide
guaaauaacuuuaauaaaacguuua

SEQ ID NO: 1280 - RNA, 25 nt, Artificial Sequence
  Synthetic oligonucleotide
uaaauaacuuuaauaaaacguuuau

SEQ ID NO: 1281 - RNA, 25 nt, Artificial Sequence
  Synthetic oligonucleotide
aaauaacuuuaauaaaacguuuaua

SEQ ID NO: 1282 - RNA, 25 nt, Artificial Sequence
  Synthetic oligonucleotide
aauaacuuuaauaaaacguuuauag

SEQ ID NO: 1283 - RNA, 25 nt, Artificial Sequence
  Synthetic oligonucleotide
auaacuuuaauaaaacguuuauagc

SEQ ID NO: 1284 - RNA, 25 nt, Artificial Sequence
  Synthetic oligonucleotide
uaacuuuaauaaaacguuuauagca

SEQ ID NO: 1285 - RNA, 25 nt, Artificial Sequence
  Synthetic oligonucleotide
aacuuuaauaaaacguuuauagcag

SEQ ID NO: 1286 - RNA, 25 nt, Artificial Sequence
  Synthetic oligonucleotide
acuuuaauaaaacguuuauagcagu

SEQ ID NO: 1287 - RNA, 25 nt, Artificial Sequence
  Synthetic oligonucleotide
cuuuaauaaaacguuuauagcaguu

SEQ ID NO: 1288 - RNA, 25 nt, Artificial Sequence
  Synthetic oligonucleotide
uuuuuaaaguugauuuuuuucuauu

SEQ ID NO: 1289 - RNA, 25 nt, Artificial Sequence
  Synthetic oligonucleotide
uuuuaaaguugauuuuuuucuauug

SEQ ID NO: 1290 - RNA, 25 nt, Artificial Sequence
  Synthetic oligonucleotide
uuuaaaguugauuuuuuucuauugu

SEQ ID NO: 1291 - RNA, 25 nt, Artificial Sequence
  Synthetic oligonucleotide
uuaaaguugauuuuuuucuauuguu

SEQ ID NO: 1292 - RNA, 25 nt, Artificial Sequence
  Synthetic oligonucleotide
uaaaguugauuuuuuucuauuguuu

SEQ ID NO: 1293 - RNA, 25 nt, Artificial Sequence
  Synthetic oligonucleotide
aaaguugauuuuuuucuauuguuuu

SEQ ID NO: 1294 - RNA, 25 nt, Artificial Sequence
  Synthetic oligonucleotide
aaguugauuuuuuucuauuguuuuu

SEQ ID NO: 1295 - RNA, 25 nt, Artificial Sequence
  Synthetic oligonucleotide
aguugauuuuuuucuauuguuuuua

SEQ ID NO: 1296 - RNA, 25 nt, Artificial Sequence
  Synthetic oligonucleotide
guugauuuuuuucuauuguuuuuag

SEQ ID NO: 1297 - RNA, 25 nt, Artificial Sequence
  Synthetic oligonucleotide
uugauuuuuuucuauuguuuuuaga

SEQ ID NO: 1298 - RNA, 25 nt, Artificial Sequence
  Synthetic oligonucleotide
ugauuuuuuucuauuguuuuuagaa

SEQ ID NO: 1299 - RNA, 25 nt, Artificial Sequence
  Synthetic oligonucleotide
gauuuuuuucuauuguuuuuagaaa

SEQ ID NO: 1300 - RNA, 25 nt, Artificial Sequence
  Synthetic oligonucleotide
auuuuuuucuauuguuuuuagaaaa

SEQ ID NO: 1301 - RNA, 25 nt, Artificial Sequence
  Synthetic oligonucleotide
uuuuuuucuauuguuuuuagaaaaa

SEQ ID NO: 1302 - RNA, 25 nt, Artificial Sequence
  Synthetic oligonucleotide
uuuuuucuauuguuuuuagaaaaaa

SEQ ID NO: 1303 - RNA, 25 nt, Artificial Sequence
  Synthetic oligonucleotide
uuuuucuauuguuuuuagaaaaaau

SEQ ID NO: 1304 - RNA, 25 nt, Artificial Sequence
  Synthetic oligonucleotide
uuuucuauuguuuuuagaaaaaaua

SEQ ID NO: 1305 - RNA, 25 nt, Artificial Sequence
  Synthetic oligonucleotide
uuucuauuguuuuuagaaaaaauaa

SEQ ID NO: 1306 - RNA, 25 nt, Artificial Sequence
  Synthetic oligonucleotide
uucuauuguuuuuagaaaaaauaaa

SEQ ID NO: 1307 - RNA, 25 nt, Artificial Sequence
  Synthetic oligonucleotide
ucuauuguuuuuagaaaaaauaaaa

SEQ ID NO: 1308 - RNA, 25 nt, Artificial Sequence
  Synthetic oligonucleotide
cuauuguuuuuagaaaaaauaaaau

SEQ ID NO: 1309 - RNA, 21 nt, Artificial Sequence
  Synthetic oligonucleotide
cucgagaagggcagggcuucu

SEQ ID NO: 1310 - RNA, 21 nt, Artificial Sequence
  Synthetic oligonucleotide
gggcuuuaucuaacucgcugu

SEQ ID NO: 1311 - RNA, 21 nt, Artificial Sequence
  Synthetic oligonucleotide
aacccuugccgcauccacgaa

SEQ ID NO: 1312 - RNA, 21 nt, Artificial Sequence
  Synthetic oligonucleotide
uugccgcauccacgaaacuuu

SEQ ID NO: 1313 - RNA, 21 nt, Artificial Sequence
  Synthetic oligonucleotide
cauccacgaaacuuugcccau

SEQ ID NO: 1314 - RNA, 21 nt, Artificial Sequence
  Synthetic oligonucleotide
gggcgggcacuuugcacugga

SEQ ID NO: 1315 - RNA, 21 nt, Artificial Sequence
  Synthetic oligonucleotide
gcacuuugcacuggaacuuac

SEQ ID NO: 1316 - RNA, 21 nt, Artificial Sequence
  Synthetic oligonucleotide
cacuggaacuuacaacacccg

SEQ ID NO: 1317 - RNA, 21 nt, Artificial Sequence
  Synthetic oligonucleotide
uugcagcugcuuagacgcugg

SEQ ID NO: 1318 - RNA, 21 nt, Artificial Sequence
  Synthetic oligonucleotide
cugcuuagacgcuggauuuuu

SEQ ID NO: 1319 - RNA, 21 nt, Artificial Sequence
  Synthetic oligonucleotide
gacgcuggauuuuuuucgggu

SEQ ID NO: 1320 - RNA, 21 nt, Artificial Sequence
  Synthetic oligonucleotide
uggauuuuuuucggguagugg

SEQ ID NO: 1321 - RNA, 21 nt, Artificial Sequence
  Synthetic oligonucleotide
uucggguaguggaaaaccagc

SEQ ID NO: 1322 - RNA, 21 nt, Artificial Sequence
  Synthetic oligonucleotide
cccucaacguuagcuucacca

SEQ ID NO: 1323 - RNA, 21 nt, Artificial Sequence
  Synthetic oligonucleotide
acguuagcuucaccaacagga

SEQ ID NO: 1324 - RNA, 21 nt, Artificial Sequence
  Synthetic oligonucleotide
acgacucggugcagccguauu

SEQ ID NO: 1325 - RNA, 21 nt, Artificial Sequence
  Synthetic oligonucleotide
gugcagccguauuucuacugc

SEQ ID NO: 1326 - RNA, 21 nt, Artificial Sequence
  Synthetic oligonucleotide
aggaggagaacuucuaccagc

SEQ ID NO: 1327 - RNA, 21 nt, Artificial Sequence
  Synthetic oligonucleotide
cagcgaggauaucuggaagaa

SEQ ID NO: 1328 - RNA, 21 nt, Artificial Sequence
  Synthetic oligonucleotide
uacguugcggucacacccuuc

SEQ ID NO: 1329 - RNA, 21 nt, Artificial Sequence
  Synthetic oligonucleotide
agacauggugaaccagaguuu

SEQ ID NO: 1330 - RNA, 21 nt, Artificial Sequence
  Synthetic oligonucleotide
acccggacgacgagaccuuca

SEQ ID NO: 1331 - RNA, 21 nt, Artificial Sequence
  Synthetic oligonucleotide
acgagaccuucaucaaaaaca

SEQ ID NO: 1332 - RNA, 21 nt, Artificial Sequence
  Synthetic oligonucleotide
ucaaaaacaucaucauccagg

SEQ ID NO: 1333 - RNA, 21 nt, Artificial Sequence
  Synthetic oligonucleotide
caggacuguauguggagcggc

SEQ ID NO: 1334 - RNA, 21 nt, Artificial Sequence
  Synthetic oligonucleotide
gucugcuccaccuccagcuug

SEQ ID NO: 1335 - RNA, 21 nt, Artificial Sequence
  Synthetic oligonucleotide
ccaccuccagcuuguaccugc

SEQ ID NO: 1336 - RNA, 21 nt, Artificial Sequence
  Synthetic oligonucleotide
uccagcuuguaccugcaggau

SEQ ID NO: 1337 - RNA, 21 nt, Artificial Sequence
  Synthetic oligonucleotide
ccaaguccugcgccucgcaag

SEQ ID NO: 1338 - RNA, 21 nt, Artificial Sequence
  Synthetic oligonucleotide
cagcagcgacucugaggagga

SEQ ID NO: 1339 - RNA, 21 nt, Artificial Sequence
  Synthetic oligonucleotide
cgacucugaggaggaacaaga

SEQ ID NO: 1340 - RNA, 21 nt, Artificial Sequence
  Synthetic oligonucleotide
cugaggaggaacaagaagaug

SEQ ID NO: 1341 - RNA, 21 nt, Artificial Sequence
  Synthetic oligonucleotide
ggaacaagaagaugaggaaga

SEQ ID NO: 1342 - RNA, 21 nt, Artificial Sequence
  Synthetic oligonucleotide
agaagaugaggaagaaaucga

SEQ ID NO: 1343 - RNA, 21 nt, Artificial Sequence
  Synthetic oligonucleotide
ugaggaagaaaucgauguugu

SEQ ID NO: 1344 - RNA, 21 nt, Artificial Sequence
  Synthetic oligonucleotide
agaaaucgauguuguuucugu

SEQ ID NO: 1345 - RNA, 21 nt, Artificial Sequence
  Synthetic oligonucleotide
cgauguuguuucuguggaaaa

SEQ ID NO: 1346 - RNA, 21 nt, Artificial Sequence
  Synthetic oligonucleotide
aagaggcaggcuccuggcaaa

SEQ ID NO: 1347 - RNA, 21 nt, Artificial Sequence
  Synthetic oligonucleotide
gcaggcuccuggcaaaagguc

SEQ ID NO: 1348 - RNA, 21 nt, Artificial Sequence
  Synthetic oligonucleotide
cuccuggcaaaaggucagagu

SEQ ID NO: 1349 - RNA, 21 nt, Artificial Sequence
  Synthetic oligonucleotide
ggcaaaaggucagagucugga

SEQ ID NO: 1350 - RNA, 21 nt, Artificial Sequence
  Synthetic oligonucleotide
aaggucagagucuggaucacc

SEQ ID NO: 1351 - RNA, 21 nt, Artificial Sequence
  Synthetic oligonucleotide
cagcaaaccuccucacagccc

SEQ ID NO: 1352 - RNA, 21 nt, Artificial Sequence
  Synthetic oligonucleotide
cuccucacagcccacuggucc

SEQ ID NO: 1353 - RNA, 21 nt, Artificial Sequence
  Synthetic oligonucleotide
cucccuccacucggaaggacu

SEQ ID NO: 1354 - RNA, 21 nt, Artificial Sequence
  Synthetic oligonucleotide
cacucggaaggacuauccugc

SEQ ID NO: 1355 - RNA, 21 nt, Artificial Sequence
  Synthetic oligonucleotide
cuauccugcugccaagagggu

SEQ ID NO: 1356 - RNA, 21 nt, Artificial Sequence
  Synthetic oligonucleotide
cugcugccaagagggucaagu

SEQ ID NO: 1357 - RNA, 21 nt, Artificial Sequence
  Synthetic oligonucleotide
gccaagagggucaaguuggac

SEQ ID NO: 1358 - RNA, 21 nt, Artificial Sequence
  Synthetic oligonucleotide
gagggucaaguuggacagugu

SEQ ID NO: 1359 - RNA, 21 nt, Artificial Sequence
  Synthetic oligonucleotide
ucaaguuggacagugucagag

SEQ ID NO: 1360 - RNA, 21 nt, Artificial Sequence
  Synthetic oligonucleotide
uuggacagugucagaguccug

SEQ ID NO: 1361 - RNA, 21 nt, Artificial Sequence
  Synthetic oligonucleotide
gucagaguccugagacagauc

SEQ ID NO: 1362 - RNA, 21 nt, Artificial Sequence
  Synthetic oligonucleotide
cugagacagaucagcaacaac

SEQ ID NO: 1363 - RNA, 21 nt, Artificial Sequence
  Synthetic oligonucleotide
cagaucagcaacaaccgaaaa

SEQ ID NO: 1364 - RNA, 21 nt, Artificial Sequence
  Synthetic oligonucleotide
guccucggacaccgaggagaa

SEQ ID NO: 1365 - RNA, 21 nt, Artificial Sequence
  Synthetic oligonucleotide
cggacaccgaggagaauguca

SEQ ID NO: 1366 - RNA, 21 nt, Artificial Sequence
  Synthetic oligonucleotide
gccagaggaggaacgagcuaa

SEQ ID NO: 1367 - RNA, 21 nt, Artificial Sequence
  Synthetic oligonucleotide
ggaggaacgagcuaaaacgga

SEQ ID NO: 1368 - RNA, 21 nt, Artificial Sequence
  Synthetic oligonucleotide
aacgagcuaaaacggagcuuu

SEQ ID NO: 1369 - RNA, 21 nt, Artificial Sequence
  Synthetic oligonucleotide
cuaaaacggagcuuuuuugcc

SEQ ID NO: 1370 - RNA, 21 nt, Artificial Sequence
  Synthetic oligonucleotide
acggagcuuuuuugcccugcg

SEQ ID NO: 1371 - RNA, 21 nt, Artificial Sequence
  Synthetic oligonucleotide
gugaccagaucccggaguugg

SEQ ID NO: 1372 - RNA, 21 nt, Artificial Sequence
  Synthetic oligonucleotide
cagaucccggaguuggaaaac

SEQ ID NO: 1373 - RNA, 21 nt, Artificial Sequence
  Synthetic oligonucleotide
cccggaguuggaaaacaauga

SEQ ID NO: 1374 - RNA, 21 nt, Artificial Sequence
  Synthetic oligonucleotide
caagguaguuauccuuaaaaa

SEQ ID NO: 1375 - RNA, 21 nt, Artificial Sequence
  Synthetic oligonucleotide
uaguuauccuuaaaaaagcca

SEQ ID NO: 1376 - RNA, 21 nt, Artificial Sequence
  Synthetic oligonucleotide
auccuuaaaaaagccacagca

SEQ ID NO: 1377 - RNA, 21 nt, Artificial Sequence
  Synthetic oligonucleotide
uaaaaaagccacagcauacau

SEQ ID NO: 1378 - RNA, 21 nt, Artificial Sequence
  Synthetic oligonucleotide
aagccacagcauacauccugu

SEQ ID NO: 1379 - RNA, 21 nt, Artificial Sequence
  Synthetic oligonucleotide
cagcauacauccuguccgucc

SEQ ID NO: 1380 - RNA, 21 nt, Artificial Sequence
  Synthetic oligonucleotide
auccuguccguccaagcagag

SEQ ID NO: 1381 - RNA, 21 nt, Artificial Sequence
  Synthetic oligonucleotide
guccguccaagcagaggagca

SEQ ID NO: 1382 - RNA, 21 nt, Artificial Sequence
  Synthetic oligonucleotide
aagcagaggagcaaaagcuca

SEQ ID NO: 1383 - RNA, 21 nt, Artificial Sequence
  Synthetic oligonucleotide
ggagcaaaagcucauuucuga

SEQ ID NO: 1384 - RNA, 21 nt, Artificial Sequence
  Synthetic oligonucleotide
aaaagcucauuucugaagagg

SEQ ID NO: 1385 - RNA, 21 nt, Artificial Sequence
  Synthetic oligonucleotide
ucauuucugaagaggacuugu

SEQ ID NO: 1386 - RNA, 21 nt, Artificial Sequence
  Synthetic oligonucleotide
cugaagaggacuuguugcgga

SEQ ID NO: 1387 - RNA, 21 nt, Artificial Sequence
  Synthetic oligonucleotide
gaggacuuguugcggaaacga

SEQ ID NO: 1388 - RNA, 21 nt, Artificial Sequence
  Synthetic oligonucleotide
cuuguugcggaaacgacgaga

SEQ ID NO: 1389 - RNA, 21 nt, Artificial Sequence
  Synthetic oligonucleotide
ugcggaaacgacgagaacagu

SEQ ID NO: 1390 - RNA, 21 nt, Artificial Sequence
  Synthetic oligonucleotide
acaaacuugaacagcuacgga

SEQ ID NO: 1391 - RNA, 21 nt, Artificial Sequence
  Synthetic oligonucleotide
uugaacagcuacggaacucuu

SEQ ID NO: 1392 - RNA, 21 nt, Artificial Sequence
  Synthetic oligonucleotide
cagcuacggaacucuugugcg

SEQ ID NO: 1393 - RNA, 21 nt, Artificial Sequence
  Synthetic oligonucleotide
ggaacucuugugcguaaggaa

SEQ ID NO: 1394 - RNA, 21 nt, Artificial Sequence
  Synthetic oligonucleotide
cuugugcguaaggaaaaguaa

SEQ ID NO: 1395 - RNA, 21 nt, Artificial Sequence
  Synthetic oligonucleotide
gcguaaggaaaaguaaggaaa

SEQ ID NO: 1396 - RNA, 21 nt, Artificial Sequence
  Synthetic oligonucleotide
aaguaaggaaaacgauuccuu

SEQ ID NO: 1397 - RNA, 21 nt, Artificial Sequence
  Synthetic oligonucleotide
aggaaaacgauuccuucuaac

SEQ ID NO: 1398 - RNA, 21 nt, Artificial Sequence
  Synthetic oligonucleotide
aacgauuccuucuaacagaaa

SEQ ID NO: 1399 - RNA, 21 nt, Artificial Sequence
  Synthetic oligonucleotide
uccuucuaacagaaauguccu

SEQ ID NO: 1400 - RNA, 21 nt, Artificial Sequence
  Synthetic oligonucleotide
aacagaaauguccugagcaau

SEQ ID NO: 1401 - RNA, 21 nt, Artificial Sequence
  Synthetic oligonucleotide
guccugagcaaucaccuauga

SEQ ID NO: 1402 - RNA, 21 nt, Artificial Sequence
  Synthetic oligonucleotide
agcaaucaccuaugaacuugu

SEQ ID NO: 1403 - RNA, 21 nt, Artificial Sequence
  Synthetic oligonucleotide
caccuaugaacuuguuucaaa

SEQ ID NO: 1404 - RNA, 21 nt, Artificial Sequence
  Synthetic oligonucleotide
augaacuuguuucaaaugcau

SEQ ID NO: 1405 - RNA, 21 nt, Artificial Sequence
  Synthetic oligonucleotide
uuguuucaaaugcaugaucaa

SEQ ID NO: 1406 - RNA, 21 nt, Artificial Sequence
  Synthetic oligonucleotide
ucaaaugcaugaucaaaugca

SEQ ID NO: 1407 - RNA, 21 nt, Artificial Sequence
  Synthetic oligonucleotide
augaucaaaugcaaccucaca

SEQ ID NO: 1408 - RNA, 21 nt, Artificial Sequence
  Synthetic oligonucleotide
caaaugcaaccucacaaccuu

SEQ ID NO: 1409 - RNA, 21 nt, Artificial Sequence
  Synthetic oligonucleotide
aaccucacaaccuuggcugag

SEQ ID NO: 1410 - RNA, 21 nt, Artificial Sequence
  Synthetic oligonucleotide
cacaaccuuggcugagucuug

SEQ ID NO: 1411 - RNA, 21 nt, Artificial Sequence
  Synthetic oligonucleotide
uuggcugagucuugagacuga

SEQ ID NO: 1412 - RNA, 21 nt, Artificial Sequence
  Synthetic oligonucleotide
gagucuugagacugaaagauu

SEQ ID NO: 1413 - RNA, 21 nt, Artificial Sequence
  Synthetic oligonucleotide
gagacugaaagauuuagccau

SEQ ID NO: 1414 - RNA, 21 nt, Artificial Sequence
  Synthetic oligonucleotide
ugaaagauuuagccauaaugu

SEQ ID NO: 1415 - RNA, 21 nt, Artificial Sequence
  Synthetic oligonucleotide
uagccauaauguaaacugccu

SEQ ID NO: 1416 - RNA, 21 nt, Artificial Sequence
  Synthetic oligonucleotide
auguaaacugccucaaauugg

SEQ ID NO: 1417 - RNA, 21 nt, Artificial Sequence
  Synthetic oligonucleotide
acugccucaaauuggacuuug

SEQ ID NO: 1418 - RNA, 21 nt, Artificial Sequence
  Synthetic oligonucleotide
cucaaauuggacuuugggcau

SEQ ID NO: 1419 - RNA, 21 nt, Artificial Sequence
  Synthetic oligonucleotide
uggacuuugggcauaaaagaa

SEQ ID NO: 1420 - RNA, 21 nt, Artificial Sequence
  Synthetic oligonucleotide
ugggcauaaaagaacuuuuuu

SEQ ID NO: 1421 - RNA, 21 nt, Artificial Sequence
  Synthetic oligonucleotide
auaaaagaacuuuuuuaugcu

SEQ ID NO: 1422 - RNA, 21 nt, Artificial Sequence
  Synthetic oligonucleotide
agaacuuuuuuaugcuuacca

SEQ ID NO: 1423 - RNA, 21 nt, Artificial Sequence
  Synthetic oligonucleotide
uuuuuaugcuuaccaucuuuu

SEQ ID NO: 1424 - RNA, 21 nt, Artificial Sequence
  Synthetic oligonucleotide
augcuuaccaucuuuuuuuuu

SEQ ID NO: 1425 - RNA, 21 nt, Artificial Sequence
  Synthetic oligonucleotide
uaccaucuuuuuuuuuucuuu

SEQ ID NO: 1426 - RNA, 21 nt, Artificial Sequence
  Synthetic oligonucleotide
cuuuuuuuuuucuuuaacaga

SEQ ID NO: 1427 - RNA, 21 nt, Artificial Sequence
  Synthetic oligonucleotide
uucuuuaacagauuuguauuu

SEQ ID NO: 1428 - RNA, 21 nt, Artificial Sequence
  Synthetic oligonucleotide
aacagauuuguauuuaagaau

SEQ ID NO: 1429 - RNA, 21 nt, Artificial Sequence
  Synthetic oligonucleotide
uguauuuaagaauuguuuuua

SEQ ID NO: 1430 - RNA, 21 nt, Artificial Sequence
  Synthetic oligonucleotide
aagaauuguuuuuaaaaaauu

SEQ ID NO: 1431 - RNA, 21 nt, Artificial Sequence
  Synthetic oligonucleotide
acaauguuucucuguaaauau

SEQ ID NO: 1432 - RNA, 21 nt, Artificial Sequence
  Synthetic oligonucleotide
cucuguaaauauugccauuaa

SEQ ID NO: 1433 - RNA, 21 nt, Artificial Sequence
  Synthetic oligonucleotide
uaaauauugccauuaaaugua

SEQ ID NO: 1434 - RNA, 21 nt, Artificial Sequence
  Synthetic oligonucleotide
ugccauuaaauguaaauaacu

SEQ ID NO: 1435 - RNA, 21 nt, Artificial Sequence
  Synthetic oligonucleotide
cuuuaauaaaacguuuauagc

SEQ ID NO: 1436 - RNA, 21 nt, Artificial Sequence
  Synthetic oligonucleotide
cacagaauuucaauccuagua

SEQ ID NO: 1437 - RNA, 21 nt, Artificial Sequence
  Synthetic oligonucleotide
accuaguauuauagguacuau

SEQ ID NO: 1438 - RNA, 21 nt, Artificial Sequence
  Synthetic oligonucleotide
auuauagguacuauaaacccu

SEQ ID NO: 1439 - RNA, 21 nt, Artificial Sequence
  Synthetic oligonucleotide
guacuauaaacccuaauuuuu

SEQ ID NO: 1440 - RNA, 21 nt, Artificial Sequence
  Synthetic oligonucleotide
aacccuaauuuuuuuuauuua

SEQ ID NO: 1441 - RNA, 21 nt, Artificial Sequence
  Synthetic oligonucleotide
uaauuuuuuuuauuuaaguac

SEQ ID NO: 1442 - RNA, 21 nt, Artificial Sequence
  Synthetic oligonucleotide
uuuauuuaaguacauuuugcu

SEQ ID NO: 1443 - RNA, 21 nt, Artificial Sequence
  Synthetic oligonucleotide
uuaaguacauuuugcuuuuua

SEQ ID NO: 1444 - RNA, 21 nt, Artificial Sequence
  Synthetic oligonucleotide
acauuuugcuuuuuaaaguug

SEQ ID NO: 1445 - RNA, 21 nt, Artificial Sequence
  Synthetic oligonucleotide
ugcuuuuuaaaguugauuuuu

SEQ ID NO: 1446 - RNA, 21 nt, Artificial Sequence
  Synthetic oligonucleotide
ucuauuguuuuuagaaaaaau

SEQ ID NO: 1447 - RNA, 21 nt, Artificial Sequence
  Synthetic oligonucleotide
uguuuuuagaaaaaauaaaau

SEQ ID NO: 1448 - RNA, 21 nt, Artificial Sequence
  Synthetic oligonucleotide
gaaaaaauaaaauaacuggca

SEQ ID NO: 1449 - RNA, 21 nt, Artificial Sequence
  Synthetic oligonucleotide
aaaauaacuggcaaauauauc

SEQ ID NO: 1450 - RNA, 21 nt, Artificial Sequence
  Synthetic oligonucleotide
ggcaaauauaucauugagcca

SEQ ID NO: 1451 - RNA, 21 nt, Artificial Sequence
  Synthetic oligonucleotide
auaucauugagccaaaucuua

SEQ ID NO: 1452 - RNA, 21 nt, Artificial Sequence
  Synthetic oligonucleotide
uugagccaaaucuuaaaaaaa

SEQ ID NO: 1453 - RNA, 21 nt, Artificial Sequence
  Synthetic oligonucleotide
uaacucgcuguaguaauucca

SEQ ID NO: 1454 - RNA, 21 nt, Artificial Sequence
  Synthetic oligonucleotide
aacucgcuguaguaauuccag

SEQ ID NO: 1455 - RNA, 21 nt, Artificial Sequence
  Synthetic oligonucleotide
acucgcuguaguaauuccagc

SEQ ID NO: 1456 - RNA, 21 nt, Artificial Sequence
  Synthetic oligonucleotide
cucgcuguaguaauuccagcg

SEQ ID NO: 1457 - RNA, 21 nt, Artificial Sequence
  Synthetic oligonucleotide
ucgcuguaguaauuccagcga

SEQ ID NO: 1458 - RNA, 21 nt, Artificial Sequence
  Synthetic oligonucleotide
cgcuguaguaauuccagcgag

SEQ ID NO: 1459 - RNA, 21 nt, Artificial Sequence
  Synthetic oligonucleotide
gcuguaguaauuccagcgaga

SEQ ID NO: 1460 - RNA, 21 nt, Artificial Sequence
  Synthetic oligonucleotide
cuguaguaauuccagcgagag

SEQ ID NO: 1461 - RNA, 21 nt, Artificial Sequence
  Synthetic oligonucleotide
agcuucaccaacaggaacuau

SEQ ID NO: 1462 - RNA, 21 nt, Artificial Sequence
  Synthetic oligonucleotide
gcuucaccaacaggaacuaug

SEQ ID NO: 1463 - RNA, 21 nt, Artificial Sequence
  Synthetic oligonucleotide
cuucaccaacaggaacuauga

SEQ ID NO: 1464 - RNA, 21 nt, Artificial Sequence
  Synthetic oligonucleotide
uucaccaacaggaacuaugac

SEQ ID NO: 1465 - RNA, 21 nt, Artificial Sequence
  Synthetic oligonucleotide
ucaccaacaggaacuaugacc

SEQ ID NO: 1466 - RNA, 21 nt, Artificial Sequence
  Synthetic oligonucleotide
caccaacaggaacuaugaccu

SEQ ID NO: 1467 - RNA, 21 nt, Artificial Sequence
  Synthetic oligonucleotide
accaacaggaacuaugaccuc

SEQ ID NO: 1468 - RNA, 21 nt, Artificial Sequence
  Synthetic oligonucleotide
ccaacaggaacuaugaccucg

SEQ ID NO: 1469 - RNA, 21 nt, Artificial Sequence
  Synthetic oligonucleotide
caacaggaacuaugaccucga

SEQ ID NO: 1470 - RNA, 21 nt, Artificial Sequence
  Synthetic oligonucleotide
aacaggaacuaugaccucgac

SEQ ID NO: 1471 - RNA, 21 nt, Artificial Sequence
  Synthetic oligonucleotide
acaggaacuaugaccucgacu

SEQ ID NO: 1472 - RNA, 21 nt, Artificial Sequence
  Synthetic oligonucleotide
caggaacuaugaccucgacua

SEQ ID NO: 1473 - RNA, 21 nt, Artificial Sequence
  Synthetic oligonucleotide
aggaacuaugaccucgacuac

SEQ ID NO: 1474 - RNA, 21 nt, Artificial Sequence
  Synthetic oligonucleotide
ggaacuaugaccucgacuacg

SEQ ID NO: 1475 - RNA, 21 nt, Artificial Sequence
  Synthetic oligonucleotide
gaacuaugaccucgacuacga

SEQ ID NO: 1476 - RNA, 21 nt, Artificial Sequence
  Synthetic oligonucleotide
aacuaugaccucgacuacgac

SEQ ID NO: 1477 - RNA, 21 nt, Artificial Sequence
  Synthetic oligonucleotide
acuaugaccucgacuacgacu

SEQ ID NO: 1478 - RNA, 21 nt, Artificial Sequence
  Synthetic oligonucleotide
cuaugaccucgacuacgacuc

SEQ ID NO: 1479 - RNA, 21 nt, Artificial Sequence
  Synthetic oligonucleotide
gcgaggauaucuggaagaaau

SEQ ID NO: 1480 - RNA, 21 nt, Artificial Sequence
  Synthetic oligonucleotide
cgaggauaucuggaagaaauu

SEQ ID NO: 1481 - RNA, 21 nt, Artificial Sequence
  Synthetic oligonucleotide
gaggauaucuggaagaaauuc

SEQ ID NO: 1482 - RNA, 21 nt, Artificial Sequence
  Synthetic oligonucleotide
aggauaucuggaagaaauucg

SEQ ID NO: 1483 - RNA, 21 nt, Artificial Sequence
  Synthetic oligonucleotide
ggauaucuggaagaaauucga

SEQ ID NO: 1484 - RNA, 21 nt, Artificial Sequence
  Synthetic oligonucleotide
gauaucuggaagaaauucgag

SEQ ID NO: 1485 - RNA, 21 nt, Artificial Sequence
  Synthetic oligonucleotide
auaucuggaagaaauucgagc

SEQ ID NO: 1486 - RNA, 21 nt, Artificial Sequence
  Synthetic oligonucleotide
uaucuggaagaaauucgagcu

SEQ ID NO: 1487 - RNA, 21 nt, Artificial Sequence
  Synthetic oligonucleotide
aucuggaagaaauucgagcug

SEQ ID NO: 1488 - RNA, 21 nt, Artificial Sequence
  Synthetic oligonucleotide
ucuggaagaaauucgagcugc

SEQ ID NO: 1489 - RNA, 21 nt, Artificial Sequence
  Synthetic oligonucleotide
cuggaagaaauucgagcugcu

SEQ ID NO: 1490 - RNA, 21 nt, Artificial Sequence
  Synthetic oligonucleotide
cuagccgccgcuccgggcucu

SEQ ID NO: 1491 - RNA, 21 nt, Artificial Sequence
  Synthetic oligonucleotide
uagccgccgcuccgggcucug

SEQ ID NO: 1492 - RNA, 21 nt, Artificial Sequence
  Synthetic oligonucleotide
agccgccgcuccgggcucugc

SEQ ID NO: 1493 - RNA, 21 nt, Artificial Sequence
  Synthetic oligonucleotide
gccgccgcuccgggcucugcu

SEQ ID NO: 1494 - RNA, 21 nt, Artificial Sequence
  Synthetic oligonucleotide
ccgccgcuccgggcucugcuc

SEQ ID NO: 1495 - RNA, 21 nt, Artificial Sequence
  Synthetic oligonucleotide
ugggaggagacauggugaacc

SEQ ID NO: 1496 - RNA, 21 nt, Artificial Sequence
  Synthetic oligonucleotide
gggaggagacauggugaacca

SEQ ID NO: 1497 - RNA, 21 nt, Artificial Sequence
  Synthetic oligonucleotide
ggaggagacauggugaaccag

SEQ ID NO: 1498 - RNA, 21 nt, Artificial Sequence
  Synthetic oligonucleotide
gaggagacauggugaaccaga

SEQ ID NO: 1499 - RNA, 21 nt, Artificial Sequence
  Synthetic oligonucleotide
aggagacauggugaaccagag

SEQ ID NO: 1500 - RNA, 21 nt, Artificial Sequence
  Synthetic oligonucleotide
cggacgacgagaccuucauca

SEQ ID NO: 1501 - RNA, 21 nt, Artificial Sequence
  Synthetic oligonucleotide
ggacgacgagaccuucaucaa

SEQ ID NO: 1502 - RNA, 21 nt, Artificial Sequence
  Synthetic oligonucleotide
aaaacaucaucauccaggacu

SEQ ID NO: 1503 - RNA, 21 nt, Artificial Sequence
  Synthetic oligonucleotide
aaacaucaucauccaggacug

SEQ ID NO: 1504 - RNA, 21 nt, Artificial Sequence
  Synthetic oligonucleotide
aacaucaucauccaggacugu

SEQ ID NO: 1505 - RNA, 21 nt, Artificial Sequence
  Synthetic oligonucleotide
acaucaucauccaggacugua

SEQ ID NO: 1506 - RNA, 21 nt, Artificial Sequence
  Synthetic oligonucleotide
caucaucauccaggacuguau

SEQ ID NO: 1507 - RNA, 21 nt, Artificial Sequence
  Synthetic oligonucleotide
aucaucauccaggacuguaug

SEQ ID NO: 1508 - RNA, 21 nt, Artificial Sequence
  Synthetic oligonucleotide
ucaucauccaggacuguaugu

SEQ ID NO: 1509 - RNA, 21 nt, Artificial Sequence
  Synthetic oligonucleotide
caucauccaggacuguaugug

SEQ ID NO: 1510 - RNA, 21 nt, Artificial Sequence
  Synthetic oligonucleotide
aucauccaggacuguaugugg

SEQ ID NO: 1511 - RNA, 21 nt, Artificial Sequence
  Synthetic oligonucleotide
ucauccaggacuguaugugga

SEQ ID NO: 1512 - RNA, 21 nt, Artificial Sequence
  Synthetic oligonucleotide
cauccaggacuguauguggag

SEQ ID NO: 1513 - RNA, 21 nt, Artificial Sequence
  Synthetic oligonucleotide
auccaggacuguauguggagc

SEQ ID NO: 1514 - RNA, 21 nt, Artificial Sequence
  Synthetic oligonucleotide
uccaggacuguauguggagcg

SEQ ID NO: 1515 - RNA, 21 nt, Artificial Sequence
  Synthetic oligonucleotide
ccaggacuguauguggagcgg

SEQ ID NO: 1516 - RNA, 21 nt, Artificial Sequence
  Synthetic oligonucleotide
cagagaagcuggccuccuacc

SEQ ID NO: 1517 - RNA, 21 nt, Artificial Sequence
  Synthetic oligonucleotide
agagaagcuggccuccuacca

SEQ ID NO: 1518 - RNA, 21 nt, Artificial Sequence
  Synthetic oligonucleotide
gagaagcuggccuccuaccag

SEQ ID NO: 1519 - RNA, 21 nt, Artificial Sequence
  Synthetic oligonucleotide
agaagcuggccuccuaccagg

SEQ ID NO: 1520 - RNA, 21 nt, Artificial Sequence
  Synthetic oligonucleotide
gaagcuggccuccuaccaggc

SEQ ID NO: 1521 - RNA, 21 nt, Artificial Sequence
  Synthetic oligonucleotide
aagcuggccuccuaccaggcu

SEQ ID NO: 1522 - RNA, 21 nt, Artificial Sequence
  Synthetic oligonucleotide
agcuggccuccuaccaggcug

SEQ ID NO: 1523 - RNA, 21 nt, Artificial Sequence
  Synthetic oligonucleotide
gcuggccuccuaccaggcugc

SEQ ID NO: 1524 - RNA, 21 nt, Artificial Sequence
  Synthetic oligonucleotide
cuggccuccuaccaggcugcg

SEQ ID NO: 1525 - RNA, 21 nt, Artificial Sequence
  Synthetic oligonucleotide
uggccuccuaccaggcugcgc

SEQ ID NO: 1526 - RNA, 21 nt, Artificial Sequence
  Synthetic oligonucleotide
ggccuccuaccaggcugcgcg

SEQ ID NO: 1527 - RNA, 21 nt, Artificial Sequence
  Synthetic oligonucleotide
gccuccuaccaggcugcgcgc

SEQ ID NO: 1528 - RNA, 21 nt, Artificial Sequence
  Synthetic oligonucleotide
ccuccuaccaggcugcgcgca

SEQ ID NO: 1529 - RNA, 21 nt, Artificial Sequence
  Synthetic oligonucleotide
cuccuaccaggcugcgcgcaa

SEQ ID NO: 1530 - RNA, 21 nt, Artificial Sequence
  Synthetic oligonucleotide
uccuaccaggcugcgcgcaaa

SEQ ID NO: 1531 - RNA, 21 nt, Artificial Sequence
  Synthetic oligonucleotide
ccuaccaggcugcgcgcaaag

SEQ ID NO: 1532 - RNA, 21 nt, Artificial Sequence
  Synthetic oligonucleotide
cuaccaggcugcgcgcaaaga

SEQ ID NO: 1533 - RNA, 21 nt, Artificial Sequence
  Synthetic oligonucleotide
uaccaggcugcgcgcaaagac

SEQ ID NO: 1534 - RNA, 21 nt, Artificial Sequence
  Synthetic oligonucleotide
accaggcugcgcgcaaagaca

SEQ ID NO: 1535 - RNA, 21 nt, Artificial Sequence
  Synthetic oligonucleotide
ccaggcugcgcgcaaagacag

SEQ ID NO: 1536 - RNA, 21 nt, Artificial Sequence
  Synthetic oligonucleotide
caggcugcgcgcaaagacagc

SEQ ID NO: 1537 - RNA, 21 nt, Artificial Sequence
  Synthetic oligonucleotide
gccacagcgucugcuccaccu

SEQ ID NO: 1538 - RNA, 21 nt, Artificial Sequence
  Synthetic oligonucleotide
ccacagcgucugcuccaccuc

SEQ ID NO: 1539 - RNA, 21 nt, Artificial Sequence
  Synthetic oligonucleotide
cacagcgucugcuccaccucc

SEQ ID NO: 1540 - RNA, 21 nt, Artificial Sequence
  Synthetic oligonucleotide
acagcgucugcuccaccucca

SEQ ID NO: 1541 - RNA, 21 nt, Artificial Sequence
  Synthetic oligonucleotide
cagcgucugcuccaccuccag

SEQ ID NO: 1542 - RNA, 21 nt, Artificial Sequence
  Synthetic oligonucleotide
agcgucugcuccaccuccagc

SEQ ID NO: 1543 - RNA, 21 nt, Artificial Sequence
  Synthetic oligonucleotide
cucucaacgacagcagcucgc

SEQ ID NO: 1544 - RNA, 21 nt, Artificial Sequence
  Synthetic oligonucleotide
ucucaacgacagcagcucgcc

SEQ ID NO: 1545 - RNA, 21 nt, Artificial Sequence
  Synthetic oligonucleotide
cucaacgacagcagcucgccc

SEQ ID NO: 1546 - RNA, 21 nt, Artificial Sequence
  Synthetic oligonucleotide
ucaacgacagcagcucgccca

SEQ ID NO: 1547 - RNA, 21 nt, Artificial Sequence
  Synthetic oligonucleotide
caacgacagcagcucgcccaa

SEQ ID NO: 1548 - RNA, 21 nt, Artificial Sequence
  Synthetic oligonucleotide
uccaugaggagacaccgccca

SEQ ID NO: 1549 - RNA, 21 nt, Artificial Sequence
  Synthetic oligonucleotide
ccaugaggagacaccgcccac

SEQ ID NO: 1550 - RNA, 21 nt, Artificial Sequence
  Synthetic oligonucleotide
caugaggagacaccgcccacc

SEQ ID NO: 1551 - RNA, 21 nt, Artificial Sequence
  Synthetic oligonucleotide
augaggagacaccgcccacca

SEQ ID NO: 1552 - RNA, 21 nt, Artificial Sequence
  Synthetic oligonucleotide
ugaggagacaccgcccaccac

SEQ ID NO: 1553 - RNA, 21 nt, Artificial Sequence
  Synthetic oligonucleotide
gaggagacaccgcccaccacc

SEQ ID NO: 1554 - RNA, 21 nt, Artificial Sequence
  Synthetic oligonucleotide
aggagacaccgcccaccacca

SEQ ID NO: 1555 - RNA, 21 nt, Artificial Sequence
  Synthetic oligonucleotide
ggagacaccgcccaccaccag

SEQ ID NO: 1556 - RNA, 21 nt, Artificial Sequence
  Synthetic oligonucleotide
gagacaccgcccaccaccagc

SEQ ID NO: 1557 - RNA, 21 nt, Artificial Sequence
  Synthetic oligonucleotide
agacaccgcccaccaccagca

SEQ ID NO: 1558 - RNA, 21 nt, Artificial Sequence
  Synthetic oligonucleotide
gacaccgcccaccaccagcag

SEQ ID NO: 1559 - RNA, 21 nt, Artificial Sequence
  Synthetic oligonucleotide
acaccgcccaccaccagcagc

SEQ ID NO: 1560 - RNA, 21 nt, Artificial Sequence
  Synthetic oligonucleotide
caccgcccaccaccagcagcg

SEQ ID NO: 1561 - RNA, 21 nt, Artificial Sequence
  Synthetic oligonucleotide
accgcccaccaccagcagcga

SEQ ID NO: 1562 - RNA, 21 nt, Artificial Sequence
  Synthetic oligonucleotide
ccgcccaccaccagcagcgac

SEQ ID NO: 1563 - RNA, 21 nt, Artificial Sequence
  Synthetic oligonucleotide
cgcccaccaccagcagcgacu

SEQ ID NO: 1564 - RNA, 21 nt, Artificial Sequence
  Synthetic oligonucleotide
gcccaccaccagcagcgacuc

SEQ ID NO: 1565 - RNA, 21 nt, Artificial Sequence
  Synthetic oligonucleotide
cccaccaccagcagcgacucu

SEQ ID NO: 1566 - RNA, 21 nt, Artificial Sequence
  Synthetic oligonucleotide
ccaccaccagcagcgacucug

SEQ ID NO: 1567 - RNA, 21 nt, Artificial Sequence
  Synthetic oligonucleotide
caccaccagcagcgacucuga

SEQ ID NO: 1568 - RNA, 21 nt, Artificial Sequence
  Synthetic oligonucleotide
aacaagaagaugaggaagaaa

SEQ ID NO: 1569 - RNA, 21 nt, Artificial Sequence
  Synthetic oligonucleotide
acaagaagaugaggaagaaau

SEQ ID NO: 1570 - RNA, 21 nt, Artificial Sequence
  Synthetic oligonucleotide
uggaggccacagcaaaccucc

SEQ ID NO: 1571 - RNA, 21 nt, Artificial Sequence
  Synthetic oligonucleotide
cucacagcccacugguccuca

SEQ ID NO: 1572 - RNA, 21 nt, Artificial Sequence
  Synthetic oligonucleotide
ucacagcccacugguccucaa

SEQ ID NO: 1573 - RNA, 21 nt, Artificial Sequence
  Synthetic oligonucleotide
cacagcccacugguccucaag

SEQ ID NO: 1574 - RNA, 21 nt, Artificial Sequence
  Synthetic oligonucleotide
acagcccacugguccucaaga

SEQ ID NO: 1575 - RNA, 21 nt, Artificial Sequence
  Synthetic oligonucleotide
cagcccacugguccucaagag

SEQ ID NO: 1576 - RNA, 21 nt, Artificial Sequence
  Synthetic oligonucleotide
agcccacugguccucaagagg

SEQ ID NO: 1577 - RNA, 21 nt, Artificial Sequence
  Synthetic oligonucleotide
gcccacugguccucaagaggu

SEQ ID NO: 1578 - RNA, 21 nt, Artificial Sequence
  Synthetic oligonucleotide
cccacugguccucaagaggug

SEQ ID NO: 1579 - RNA, 21 nt, Artificial Sequence
  Synthetic oligonucleotide
ccacugguccucaagaggugc

SEQ ID NO: 1580 - RNA, 21 nt, Artificial Sequence
  Synthetic oligonucleotide
cacugguccucaagaggugcc

SEQ ID NO: 1581 - RNA, 21 nt, Artificial Sequence
  Synthetic oligonucleotide
acugguccucaagaggugcca

SEQ ID NO: 1582 - RNA, 21 nt, Artificial Sequence
  Synthetic oligonucleotide
cugguccucaagaggugccac

SEQ ID NO: 1583 - RNA, 21 nt, Artificial Sequence
  Synthetic oligonucleotide
ugguccucaagaggugccacg

SEQ ID NO: 1584 - RNA, 21 nt, Artificial Sequence
  Synthetic oligonucleotide
gguccucaagaggugccacgu

SEQ ID NO: 1585 - RNA, 21 nt, Artificial Sequence
  Synthetic oligonucleotide
guccucaagaggugccacguc

SEQ ID NO: 1586 - RNA, 21 nt, Artificial Sequence
  Synthetic oligonucleotide
uccucaagaggugccacgucu

SEQ ID NO: 1587 - RNA, 21 nt, Artificial Sequence
  Synthetic oligonucleotide
ggagcuuuuuugcccugcgug

SEQ ID NO: 1588 - RNA, 21 nt, Artificial Sequence
  Synthetic oligonucleotide
gagcuuuuuugcccugcguga

SEQ ID NO: 1589 - RNA, 21 nt, Artificial Sequence
  Synthetic oligonucleotide
agcuuuuuugcccugcgugac

SEQ ID NO: 1590 - RNA, 21 nt, Artificial Sequence
  Synthetic oligonucleotide
gcuuuuuugcccugcgugacc

SEQ ID NO: 1591 - RNA, 21 nt, Artificial Sequence
  Synthetic oligonucleotide
cuuuuuugcccugcgugacca

SEQ ID NO: 1592 - RNA, 21 nt, Artificial Sequence
  Synthetic oligonucleotide
uuuuuugcccugcgugaccag

SEQ ID NO: 1593 - RNA, 21 nt, Artificial Sequence
  Synthetic oligonucleotide
uuuuugcccugcgugaccaga

SEQ ID NO: 1594 - RNA, 21 nt, Artificial Sequence
  Synthetic oligonucleotide
uuuugcccugcgugaccagau

SEQ ID NO: 1595 - RNA, 21 nt, Artificial Sequence
  Synthetic oligonucleotide
uuugcccugcgugaccagauc

SEQ ID NO: 1596 - RNA, 21 nt, Artificial Sequence
  Synthetic oligonucleotide
uugcccugcgugaccagaucc

SEQ ID NO: 1597 - RNA, 21 nt, Artificial Sequence
  Synthetic oligonucleotide
ugcccugcgugaccagauccc

SEQ ID NO: 1598 - RNA, 21 nt, Artificial Sequence
  Synthetic oligonucleotide
gcggaaacgacgagaacaguu

SEQ ID NO: 1599 - RNA, 21 nt, Artificial Sequence
  Synthetic oligonucleotide
cggaaacgacgagaacaguug

SEQ ID NO: 1600 - RNA, 21 nt, Artificial Sequence
  Synthetic oligonucleotide
ucuuuaacagauuuguauuua

SEQ ID NO: 1601 - RNA, 21 nt, Artificial Sequence
  Synthetic oligonucleotide
cuuuaacagauuuguauuuaa

SEQ ID NO: 1602 - RNA, 21 nt, Artificial Sequence
  Synthetic oligonucleotide
uuaaauguaaauaacuuuaau

SEQ ID NO: 1603 - RNA, 21 nt, Artificial Sequence
  Synthetic oligonucleotide
uaaauguaaauaacuuuaaua

SEQ ID NO: 1604 - RNA, 21 nt, Artificial Sequence
  Synthetic oligonucleotide
aaauguaaauaacuuuaauaa

SEQ ID NO: 1605 - RNA, 21 nt, Artificial Sequence
  Synthetic oligonucleotide
aauguaaauaacuuuaauaaa

SEQ ID NO: 1606 - RNA, 21 nt, Artificial Sequence
  Synthetic oligonucleotide
auguaaauaacuuuaauaaaa

SEQ ID NO: 1607 - RNA, 21 nt, Artificial Sequence
  Synthetic oligonucleotide
uguaaauaacuuuaauaaaac

SEQ ID NO: 1608 - RNA, 21 nt, Artificial Sequence
  Synthetic oligonucleotide
guaaauaacuuuaauaaaacg

SEQ ID NO: 1609 - RNA, 21 nt, Artificial Sequence
  Synthetic oligonucleotide
uaaauaacuuuaauaaaacgu

SEQ ID NO: 1610 - RNA, 21 nt, Artificial Sequence
  Synthetic oligonucleotide
aaauaacuuuaauaaaacguu

SEQ ID NO: 1611 - RNA, 21 nt, Artificial Sequence
  Synthetic oligonucleotide
aauaacuuuaauaaaacguuu

SEQ ID NO: 1612 - RNA, 21 nt, Artificial Sequence
  Synthetic oligonucleotide
auaacuuuaauaaaacguuua

SEQ ID NO: 1613 - RNA, 21 nt, Artificial Sequence
  Synthetic oligonucleotide
uaacuuuaauaaaacguuuau

SEQ ID NO: 1614 - RNA, 21 nt, Artificial Sequence
  Synthetic oligonucleotide
aacuuuaauaaaacguuuaua

SEQ ID NO: 1615 - RNA, 21 nt, Artificial Sequence
  Synthetic oligonucleotide
gcuuuuuaaaguugauuuuuu

SEQ ID NO: 1616 - RNA, 21 nt, Artificial Sequence
  Synthetic oligonucleotide
cuuuuuaaaguugauuuuuuu

SEQ ID NO: 1617 - RNA, 21 nt, Artificial Sequence
  Synthetic oligonucleotide
uuuuuaaaguugauuuuuuuc

SEQ ID NO: 1618 - RNA, 21 nt, Artificial Sequence
  Synthetic oligonucleotide
uuuuaaaguugauuuuuuucu

SEQ ID NO: 1619 - RNA, 21 nt, Artificial Sequence
  Synthetic oligonucleotide
uuuaaaguugauuuuuuucua

SEQ ID NO: 1620 - RNA, 21 nt, Artificial Sequence
  Synthetic oligonucleotide
uuaaaguugauuuuuuucuau

SEQ ID NO: 1621 - RNA, 21 nt, Artificial Sequence
  Synthetic oligonucleotide
uaaaguugauuuuuuucuauu

SEQ ID NO: 1622 - RNA, 21 nt, Artificial Sequence
  Synthetic oligonucleotide
aaaguugauuuuuuucuauug

SEQ ID NO: 1623 - RNA, 21 nt, Artificial Sequence
  Synthetic oligonucleotide
aaguugauuuuuuucuauugu

SEQ ID NO: 1624 - RNA, 21 nt, Artificial Sequence
  Synthetic oligonucleotide
aguugauuuuuuucuauuguu

SEQ ID NO: 1625 - RNA, 21 nt, Artificial Sequence
  Synthetic oligonucleotide
guugauuuuuuucuauuguuu

SEQ ID NO: 1626 - RNA, 21 nt, Artificial Sequence
  Synthetic oligonucleotide
uugauuuuuuucuauuguuuu

SEQ ID NO: 1627 - RNA, 21 nt, Artificial Sequence
  Synthetic oligonucleotide
ugauuuuuuucuauuguuuuu

SEQ ID NO: 1628 - RNA, 21 nt, Artificial Sequence
  Synthetic oligonucleotide
gauuuuuuucuauuguuuuua

SEQ ID NO: 1629 - RNA, 21 nt, Artificial Sequence
  Synthetic oligonucleotide
auuuuuuucuauuguuuuuag

SEQ ID NO: 1630 - RNA, 21 nt, Artificial Sequence
  Synthetic oligonucleotide
uuuuuuucuauuguuuuuaga

SEQ ID NO: 1631 - RNA, 21 nt, Artificial Sequence
  Synthetic oligonucleotide
uuuuuucuauuguuuuuagaa

SEQ ID NO: 1632 - RNA, 21 nt, Artificial Sequence
  Synthetic oligonucleotide
uuuuucuauuguuuuuagaaa

SEQ ID NO: 1633 - RNA, 21 nt, Artificial Sequence
  Synthetic oligonucleotide
uuuucuauuguuuuuagaaaa

SEQ ID NO: 1634 - RNA, 21 nt, Artificial Sequence
  Synthetic oligonucleotide
uuucuauuguuuuuagaaaaa

SEQ ID NO: 1635 - RNA, 21 nt, Artificial Sequence
  Synthetic oligonucleotide
uucuauuguuuuuagaaaaaa

SEQ ID NO: 1636 - RNA, 27 nt, Artificial Sequence
  Synthetic oligonucleotide
cucgagaagggcagggcuucucagaaa

SEQ ID NO: 1637 - RNA, 27 nt, Artificial Sequence
  Synthetic oligonucleotide
gggcuuuaucuaacucgcuguaguacc

SEQ ID NO: 1638 - RNA, 27 nt, Artificial Sequence
  Synthetic oligonucleotide
aacccuugccgcauccacgaaacuuca

SEQ ID NO: 1639 - RNA, 27 nt, Artificial Sequence
  Synthetic oligonucleotide
uugccgcauccacgaaacuuugccccc

SEQ ID NO: 1640 - RNA, 27 nt, Artificial Sequence
  Synthetic oligonucleotide
cauccacgaaacuuugcccauagcaaa

SEQ ID NO: 1641 - RNA, 27 nt, Artificial Sequence
  Synthetic oligonucleotide
gggcgggcacuuugcacuggaacuuca

SEQ ID NO: 1642 - RNA, 27 nt, Artificial Sequence
  Synthetic oligonucleotide
gcacuuugcacuggaacuuacaacaaa

SEQ ID NO: 1643 - RNA, 27 nt, Artificial Sequence
  Synthetic oligonucleotide
cacuggaacuuacaacacccgagcaca

SEQ ID NO: 1644 - RNA, 27 nt, Artificial Sequence
  Synthetic oligonucleotide
uugcagcugcuuagacgcuggauuucc

SEQ ID NO: 1645 - RNA, 27 nt, Artificial Sequence
  Synthetic oligonucleotide
cugcuuagacgcuggauuuuuuucgaa

SEQ ID NO: 1646 - RNA, 27 nt, Artificial Sequence
  Synthetic oligonucleotide
gacgcuggauuuuuuucggguagugac

SEQ ID NO: 1647 - RNA, 27 nt, Artificial Sequence
  Synthetic oligonucleotide
uggauuuuuuucggguaguggaaaaaa

SEQ ID NO: 1648 - RNA, 27 nt, Artificial Sequence
  Synthetic oligonucleotide
uucggguaguggaaaaccagcagccca

SEQ ID NO: 1649 - RNA, 27 nt, Artificial Sequence
  Synthetic oligonucleotide
cccucaacguuagcuucaccaacagac

SEQ ID NO: 1650 - RNA, 27 nt, Artificial Sequence
  Synthetic oligonucleotide
acguuagcuucaccaacaggaacuaca

SEQ ID NO: 1651 - RNA, 27 nt, Artificial Sequence
  Synthetic oligonucleotide
acgacucggugcagccguauuucuaac

SEQ ID NO: 1652 - RNA, 27 nt, Artificial Sequence
  Synthetic oligonucleotide
gugcagccguauuucuacugcgacgca

SEQ ID NO: 1653 - RNA, 27 nt, Artificial Sequence
  Synthetic oligonucleotide
aggaggagaacuucuaccagcagcaaa

SEQ ID NO: 1654 - RNA, 27 nt, Artificial Sequence
  Synthetic oligonucleotide
cagcgaggauaucuggaagaaauucac

SEQ ID NO: 1655 - RNA, 27 nt, Artificial Sequence
  Synthetic oligonucleotide
uacguugcggucacacccuucuccccc

SEQ ID NO: 1656 - RNA, 27 nt, Artificial Sequence
  Synthetic oligonucleotide
agacauggugaaccagaguuucaucca

SEQ ID NO: 1657 - RNA, 27 nt, Artificial Sequence
  Synthetic oligonucleotide
acccggacgacgagaccuucaucaacc

SEQ ID NO: 1658 - RNA, 27 nt, Artificial Sequence
  Synthetic oligonucleotide
acgagaccuucaucaaaaacaucauac

SEQ ID NO: 1659 - RNA, 27 nt, Artificial Sequence
  Synthetic oligonucleotide
ucaaaaacaucaucauccaggacugcc

SEQ ID NO: 1660 - RNA, 27 nt, Artificial Sequence
  Synthetic oligonucleotide
caggacuguauguggagcggcuucuaa

SEQ ID NO: 1661 - RNA, 27 nt, Artificial Sequence
  Synthetic oligonucleotide
gucugcuccaccuccagcuuguaccca

SEQ ID NO: 1662 - RNA, 27 nt, Artificial Sequence
  Synthetic oligonucleotide
ccaccuccagcuuguaccugcaggaca

SEQ ID NO: 1663 - RNA, 27 nt, Artificial Sequence
  Synthetic oligonucleotide
uccagcuuguaccugcaggaucugaaa

SEQ ID NO: 1664 - RNA, 27 nt, Artificial Sequence
  Synthetic oligonucleotide
ccaaguccugcgccucgcaagacucac

SEQ ID NO: 1665 - RNA, 27 nt, Artificial Sequence
  Synthetic oligonucleotide
cagcagcgacucugaggaggaacaaac

SEQ ID NO: 1666 - RNA, 27 nt, Artificial Sequence
  Synthetic oligonucleotide
cgacucugaggaggaacaagaagauac

SEQ ID NO: 1667 - RNA, 27 nt, Artificial Sequence
  Synthetic oligonucleotide
cugaggaggaacaagaagaugaggaca

SEQ ID NO: 1668 - RNA, 27 nt, Artificial Sequence
  Synthetic oligonucleotide
ggaacaagaagaugaggaagaaaucac

SEQ ID NO: 1669 - RNA, 27 nt, Artificial Sequence
  Synthetic oligonucleotide
agaagaugaggaagaaaucgauguuac

SEQ ID NO: 1670 - RNA, 27 nt, Artificial Sequence
  Synthetic oligonucleotide
ugaggaagaaaucgauguuguuucuac

SEQ ID NO: 1671 - RNA, 27 nt, Artificial Sequence
  Synthetic oligonucleotide
agaaaucgauguuguuucuguggaacc

SEQ ID NO: 1672 - RNA, 27 nt, Artificial Sequence
  Synthetic oligonucleotide
cgauguuguuucuguggaaaagaggac

SEQ ID NO: 1673 - RNA, 27 nt, Artificial Sequence
  Synthetic oligonucleotide
aagaggcaggcuccuggcaaaagguac

SEQ ID NO: 1674 - RNA, 27 nt, Artificial Sequence
  Synthetic oligonucleotide
gcaggcuccuggcaaaaggucagagca

SEQ ID NO: 1675 - RNA, 27 nt, Artificial Sequence
  Synthetic oligonucleotide
cuccuggcaaaaggucagagucuggcc

SEQ ID NO: 1676 - RNA, 27 nt, Artificial Sequence
  Synthetic oligonucleotide
ggcaaaaggucagagucuggaucacac

SEQ ID NO: 1677 - RNA, 27 nt, Artificial Sequence
  Synthetic oligonucleotide
aaggucagagucuggaucaccuucuaa

SEQ ID NO: 1678 - RNA, 27 nt, Artificial Sequence
  Synthetic oligonucleotide
cagcaaaccuccucacagcccacugac

SEQ ID NO: 1679 - RNA, 27 nt, Artificial Sequence
  Synthetic oligonucleotide
cuccucacagcccacugguccucaaac

SEQ ID NO: 1680 - RNA, 27 nt, Artificial Sequence
  Synthetic oligonucleotide
cucccuccacucggaaggacuauccca

SEQ ID NO: 1681 - RNA, 27 nt, Artificial Sequence
  Synthetic oligonucleotide
cacucggaaggacuauccugcugcccc

SEQ ID NO: 1682 - RNA, 27 nt, Artificial Sequence
  Synthetic oligonucleotide
cuauccugcugccaagagggucaagcc

SEQ ID NO: 1683 - RNA, 27 nt, Artificial Sequence
  Synthetic oligonucleotide
cugcugccaagagggucaaguuggaac

SEQ ID NO: 1684 - RNA, 27 nt, Artificial Sequence
  Synthetic oligonucleotide
gccaagagggucaaguuggacagugca

SEQ ID NO: 1685 - RNA, 27 nt, Artificial Sequence
  Synthetic oligonucleotide
gagggucaaguuggacagugucagaac

SEQ ID NO: 1686 - RNA, 27 nt, Artificial Sequence
  Synthetic oligonucleotide
ucaaguuggacagugucagaguccuac

SEQ ID NO: 1687 - RNA, 27 nt, Artificial Sequence
  Synthetic oligonucleotide
uuggacagugucagaguccugagacca

SEQ ID NO: 1688 - RNA, 27 nt, Artificial Sequence
  Synthetic oligonucleotide
gucagaguccugagacagaucagcaca

SEQ ID NO: 1689 - RNA, 27 nt, Artificial Sequence
  Synthetic oligonucleotide
cugagacagaucagcaacaaccgaacc

SEQ ID NO: 1690 - RNA, 27 nt, Artificial Sequence
  Synthetic oligonucleotide
cagaucagcaacaaccgaaaaugcaaa

SEQ ID NO: 1691 - RNA, 27 nt, Artificial Sequence
  Synthetic oligonucleotide
guccucggacaccgaggagaauguccc

SEQ ID NO: 1692 - RNA, 27 nt, Artificial Sequence
  Synthetic oligonucleotide
cggacaccgaggagaaugucaagagaa

SEQ ID NO: 1693 - RNA, 27 nt, Artificial Sequence
  Synthetic oligonucleotide
gccagaggaggaacgagcuaaaacgac

SEQ ID NO: 1694 - RNA, 27 nt, Artificial Sequence
  Synthetic oligonucleotide
ggaggaacgagcuaaaacggagcuucc

SEQ ID NO: 1695 - RNA, 27 nt, Artificial Sequence
  Synthetic oligonucleotide
aacgagcuaaaacggagcuuuuuugaa

SEQ ID NO: 1696 - RNA, 27 nt, Artificial Sequence
  Synthetic oligonucleotide
cuaaaacggagcuuuuuugcccugcac

SEQ ID NO: 1697 - RNA, 27 nt, Artificial Sequence
  Synthetic oligonucleotide
acggagcuuuuuugcccugcgugacac

SEQ ID NO: 1698 - RNA, 27 nt, Artificial Sequence
  Synthetic oligonucleotide
gugaccagaucccggaguuggaaaaac

SEQ ID NO: 1699 - RNA, 27 nt, Artificial Sequence
  Synthetic oligonucleotide
cagaucccggaguuggaaaacaaugcc

SEQ ID NO: 1700 - RNA, 27 nt, Artificial Sequence
  Synthetic oligonucleotide
cccggaguuggaaaacaaugaaaagaa

SEQ ID NO: 1701 - RNA, 27 nt, Artificial Sequence
  Synthetic oligonucleotide
caagguaguuauccuuaaaaaagccca

SEQ ID NO: 1702 - RNA, 27 nt, Artificial Sequence
  Synthetic oligonucleotide
uaguuauccuuaaaaaagccacagccc

SEQ ID NO: 1703 - RNA, 27 nt, Artificial Sequence
  Synthetic oligonucleotide
auccuuaaaaaagccacagcauacaca

SEQ ID NO: 1704 - RNA, 27 nt, Artificial Sequence
  Synthetic oligonucleotide
uaaaaaagccacagcauacauccugca

SEQ ID NO: 1705 - RNA, 27 nt, Artificial Sequence
  Synthetic oligonucleotide
aagccacagcauacauccuguccguaa

SEQ ID NO: 1706 - RNA, 27 nt, Artificial Sequence
  Synthetic oligonucleotide
cagcauacauccuguccguccaagcca

SEQ ID NO: 1707 - RNA, 27 nt, Artificial Sequence
  Synthetic oligonucleotide
auccuguccguccaagcagaggagccc

SEQ ID NO: 1708 - RNA, 27 nt, Artificial Sequence
  Synthetic oligonucleotide
guccguccaagcagaggagcaaaagac

SEQ ID NO: 1709 - RNA, 27 nt, Artificial Sequence
  Synthetic oligonucleotide
aagcagaggagcaaaagcucauuucca

SEQ ID NO: 1710 - RNA, 27 nt, Artificial Sequence
  Synthetic oligonucleotide
ggagcaaaagcucauuucugaagagac

SEQ ID NO: 1711 - RNA, 27 nt, Artificial Sequence
  Synthetic oligonucleotide
aaaagcucauuucugaagaggacuuac

SEQ ID NO: 1712 - RNA, 27 nt, Artificial Sequence
  Synthetic oligonucleotide
ucauuucugaagaggacuuguugcgac

SEQ ID NO: 1713 - RNA, 27 nt, Artificial Sequence
  Synthetic oligonucleotide
cugaagaggacuuguugcggaaacgca

SEQ ID NO: 1714 - RNA, 27 nt, Artificial Sequence
  Synthetic oligonucleotide
gaggacuuguugcggaaacgacgagcc

SEQ ID NO: 1715 - RNA, 27 nt, Artificial Sequence
  Synthetic oligonucleotide
cuuguugcggaaacgacgagaacagcc

SEQ ID NO: 1716 - RNA, 27 nt, Artificial Sequence
  Synthetic oligonucleotide
ugcggaaacgacgagaacaguugaaca

SEQ ID NO: 1717 - RNA, 27 nt, Artificial Sequence
  Synthetic oligonucleotide
acaaacuugaacagcuacggaacuccc

SEQ ID NO: 1718 - RNA, 27 nt, Artificial Sequence
  Synthetic oligonucleotide
uugaacagcuacggaacucuugugcac

SEQ ID NO: 1719 - RNA, 27 nt, Artificial Sequence
  Synthetic oligonucleotide
cagcuacggaacucuugugcguaagac

SEQ ID NO: 1720 - RNA, 27 nt, Artificial Sequence
  Synthetic oligonucleotide
ggaacucuugugcguaaggaaaagucc

SEQ ID NO: 1721 - RNA, 27 nt, Artificial Sequence
  Synthetic oligonucleotide
cuugugcguaaggaaaaguaaggaacc

SEQ ID NO: 1722 - RNA, 27 nt, Artificial Sequence
  Synthetic oligonucleotide
gcguaaggaaaaguaaggaaaacgacc

SEQ ID NO: 1723 - RNA, 27 nt, Artificial Sequence
  Synthetic oligonucleotide
aaguaaggaaaacgauuccuucuaaac

SEQ ID NO: 1724 - RNA, 27 nt, Artificial Sequence
  Synthetic oligonucleotide
aggaaaacgauuccuucuaacagaacc

SEQ ID NO: 1725 - RNA, 27 nt, Artificial Sequence
  Synthetic oligonucleotide
aacgauuccuucuaacagaaaugucac

SEQ ID NO: 1726 - RNA, 27 nt, Artificial Sequence
  Synthetic oligonucleotide
uccuucuaacagaaauguccugagccc

SEQ ID NO: 1727 - RNA, 27 nt, Artificial Sequence
  Synthetic oligonucleotide
aacagaaauguccugagcaaucacccc

SEQ ID NO: 1728 - RNA, 27 nt, Artificial Sequence
  Synthetic oligonucleotide
guccugagcaaucaccuaugaacuuac

SEQ ID NO: 1729 - RNA, 27 nt, Artificial Sequence
  Synthetic oligonucleotide
agcaaucaccuaugaacuuguuucacc

SEQ ID NO: 1730 - RNA, 27 nt, Artificial Sequence
  Synthetic oligonucleotide
caccuaugaacuuguuucaaaugcaca

SEQ ID NO: 1731 - RNA, 27 nt, Artificial Sequence
  Synthetic oligonucleotide
augaacuuguuucaaaugcaugauccc

SEQ ID NO: 1732 - RNA, 27 nt, Artificial Sequence
  Synthetic oligonucleotide
uuguuucaaaugcaugaucaaaugccc

SEQ ID NO: 1733 - RNA, 27 nt, Artificial Sequence
  Synthetic oligonucleotide
ucaaaugcaugaucaaaugcaaccuac

SEQ ID NO: 1734 - RNA, 27 nt, Artificial Sequence
  Synthetic oligonucleotide
augaucaaaugcaaccucacaaccuca

SEQ ID NO: 1735 - RNA, 27 nt, Artificial Sequence
  Synthetic oligonucleotide
caaaugcaaccucacaaccuuggcuac

SEQ ID NO: 1736 - RNA, 27 nt, Artificial Sequence
  Synthetic oligonucleotide
aaccucacaaccuuggcugagucuuac

SEQ ID NO: 1737 - RNA, 27 nt, Artificial Sequence
  Synthetic oligonucleotide
cacaaccuuggcugagucuugagacca

SEQ ID NO: 1738 - RNA, 27 nt, Artificial Sequence
  Synthetic oligonucleotide
uuggcugagucuugagacugaaagacc

SEQ ID NO: 1739 - RNA, 27 nt, Artificial Sequence
  Synthetic oligonucleotide
gagucuugagacugaaagauuuagcac

SEQ ID NO: 1740 - RNA, 27 nt, Artificial Sequence
  Synthetic oligonucleotide
gagacugaaagauuuagccauaaugcc

SEQ ID NO: 1741 - RNA, 27 nt, Artificial Sequence
  Synthetic oligonucleotide
ugaaagauuuagccauaauguaaacca

SEQ ID NO: 1742 - RNA, 27 nt, Artificial Sequence
  Synthetic oligonucleotide
uagccauaauguaaacugccucaaacc

SEQ ID NO: 1743 - RNA, 27 nt, Artificial Sequence
  Synthetic oligonucleotide
auguaaacugccucaaauuggacuuca

SEQ ID NO: 1744 - RNA, 27 nt, Artificial Sequence
  Synthetic oligonucleotide
acugccucaaauuggacuuugggcacc

SEQ ID NO: 1745 - RNA, 27 nt, Artificial Sequence
  Synthetic oligonucleotide
cucaaauuggacuuugggcauaaaaac

SEQ ID NO: 1746 - RNA, 27 nt, Artificial Sequence
  Synthetic oligonucleotide
uggacuuugggcauaaaagaacuuucc

SEQ ID NO: 1747 - RNA, 27 nt, Artificial Sequence
  Synthetic oligonucleotide
ugggcauaaaagaacuuuuuuaugccc

SEQ ID NO: 1748 - RNA, 27 nt, Artificial Sequence
  Synthetic oligonucleotide
auaaaagaacuuuuuuaugcuuacccc

SEQ ID NO: 1749 - RNA, 27 nt, Artificial Sequence
  Synthetic oligonucleotide
agaacuuuuuuaugcuuaccaucuucc

SEQ ID NO: 1750 - RNA, 27 nt, Artificial Sequence
  Synthetic oligonucleotide
uuuuuaugcuuaccaucuuuuuuuucc

SEQ ID NO: 1751 - RNA, 27 nt, Artificial Sequence
  Synthetic oligonucleotide
augcuuaccaucuuuuuuuuuucuucc

SEQ ID NO: 1752 - RNA, 27 nt, Artificial Sequence
  Synthetic oligonucleotide
uaccaucuuuuuuuuuucuuuaacaac

SEQ ID NO: 1753 - RNA, 27 nt, Artificial Sequence
  Synthetic oligonucleotide
cuuuuuuuuuucuuuaacagauuugcc

SEQ ID NO: 1754 - RNA, 27 nt, Artificial Sequence
  Synthetic oligonucleotide
uucuuuaacagauuuguauuuaagacc

SEQ ID NO: 1755 - RNA, 27 nt, Artificial Sequence
  Synthetic oligonucleotide
aacagauuuguauuuaagaauuguucc

SEQ ID NO: 1756 - RNA, 27 nt, Artificial Sequence
  Synthetic oligonucleotide
uguauuuaagaauuguuuuuaaaaacc

SEQ ID NO: 1757 - RNA, 27 nt, Artificial Sequence
  Synthetic oligonucleotide
aagaauuguuuuuaaaaaauuuuaaac

SEQ ID NO: 1758 - RNA, 27 nt, Artificial Sequence
  Synthetic oligonucleotide
acaauguuucucuguaaauauugcccc

SEQ ID NO: 1759 - RNA, 27 nt, Artificial Sequence
  Synthetic oligonucleotide
cucuguaaauauugccauuaaaugucc

SEQ ID NO: 1760 - RNA, 27 nt, Artificial Sequence
  Synthetic oligonucleotide
uaaauauugccauuaaauguaaauaca

SEQ ID NO: 1761 - RNA, 27 nt, Artificial Sequence
  Synthetic oligonucleotide
ugccauuaaauguaaauaacuuuaacc

SEQ ID NO: 1762 - RNA, 27 nt, Artificial Sequence
  Synthetic oligonucleotide
cuuuaauaaaacguuuauagcaguuca

SEQ ID NO: 1763 - RNA, 27 nt, Artificial Sequence
  Synthetic oligonucleotide
cacagaauuucaauccuaguauauaac

SEQ ID NO: 1764 - RNA, 27 nt, Artificial Sequence
  Synthetic oligonucleotide
accuaguauuauagguacuauaaacaa

SEQ ID NO: 1765 - RNA, 27 nt, Artificial Sequence
  Synthetic oligonucleotide
auuauagguacuauaaacccuaauucc

SEQ ID NO: 1766 - RNA, 27 nt, Artificial Sequence
  Synthetic oligonucleotide
guacuauaaacccuaauuuuuuuuacc

SEQ ID NO: 1767 - RNA, 27 nt, Artificial Sequence
  Synthetic oligonucleotide
aacccuaauuuuuuuuauuuaaguaac

SEQ ID NO: 1768 - RNA, 27 nt, Artificial Sequence
  Synthetic oligonucleotide
uaauuuuuuuuauuuaaguacauuuca

SEQ ID NO: 1769 - RNA, 27 nt, Artificial Sequence
  Synthetic oligonucleotide
uuuauuuaaguacauuuugcuuuuucc

SEQ ID NO: 1770 - RNA, 27 nt, Artificial Sequence
  Synthetic oligonucleotide
uuaaguacauuuugcuuuuuaaaguca

SEQ ID NO: 1771 - RNA, 27 nt, Artificial Sequence
  Synthetic oligonucleotide
acauuuugcuuuuuaaaguugauuucc

SEQ ID NO: 1772 - RNA, 27 nt, Artificial Sequence
  Synthetic oligonucleotide
ugcuuuuuaaaguugauuuuuuucucc

SEQ ID NO: 1773 - RNA, 27 nt, Artificial Sequence
  Synthetic oligonucleotide
ucuauuguuuuuagaaaaaauaaaacc

SEQ ID NO: 1774 - RNA, 27 nt, Artificial Sequence
  Synthetic oligonucleotide
uguuuuuagaaaaaauaaaauaacuaa

SEQ ID NO: 1775 - RNA, 27 nt, Artificial Sequence
  Synthetic oligonucleotide
gaaaaaauaaaauaacuggcaaauacc

SEQ ID NO: 1776 - RNA, 27 nt, Artificial Sequence
  Synthetic oligonucleotide
aaaauaacuggcaaauauaucauugca

SEQ ID NO: 1777 - RNA, 27 nt, Artificial Sequence
  Synthetic oligonucleotide
ggcaaauauaucauugagccaaauccc

SEQ ID NO: 1778 - RNA, 27 nt, Artificial Sequence
  Synthetic oligonucleotide
auaucauugagccaaaucuuaaaaacc

SEQ ID NO: 1779 - RNA, 27 nt, Artificial Sequence
  Synthetic oligonucleotide
uugagccaaaucuuaaaaaaaaaaacc

SEQ ID NO: 1780 - RNA, 27 nt, Artificial Sequence
  Synthetic oligonucleotide
uaacucgcuguaguaauuccagcgaac

SEQ ID NO: 1781 - RNA, 27 nt, Artificial Sequence
  Synthetic oligonucleotide
aacucgcuguaguaauuccagcgagca

SEQ ID NO: 1782 - RNA, 27 nt, Artificial Sequence
  Synthetic oligonucleotide
acucgcuguaguaauuccagcgagaaa

SEQ ID NO: 1783 - RNA, 27 nt, Artificial Sequence
  Synthetic oligonucleotide
cucgcuguaguaauuccagcgagagaa

SEQ ID NO: 1784 - RNA, 27 nt, Artificial Sequence
  Synthetic oligonucleotide
ucgcuguaguaauuccagcgagaggac

SEQ ID NO: 1785 - RNA, 27 nt, Artificial Sequence
  Synthetic oligonucleotide
cgcuguaguaauuccagcgagaggcca

SEQ ID NO: 1786 - RNA, 27 nt, Artificial Sequence
  Synthetic oligonucleotide
gcuguaguaauuccagcgagaggcaac

SEQ ID NO: 1787 - RNA, 27 nt, Artificial Sequence
  Synthetic oligonucleotide
cuguaguaauuccagcgagaggcagca

SEQ ID NO: 1788 - RNA, 27 nt, Artificial Sequence
  Synthetic oligonucleotide
agcuucaccaacaggaacuaugaccca

SEQ ID NO: 1789 - RNA, 27 nt, Artificial Sequence
  Synthetic oligonucleotide
gcuucaccaacaggaacuaugaccuaa

SEQ ID NO: 1790 - RNA, 27 nt, Artificial Sequence
  Synthetic oligonucleotide
cuucaccaacaggaacuaugaccucac

SEQ ID NO: 1791 - RNA, 27 nt, Artificial Sequence
  Synthetic oligonucleotide
uucaccaacaggaacuaugaccucgca

SEQ ID NO: 1792 - RNA, 27 nt, Artificial Sequence
  Synthetic oligonucleotide
ucaccaacaggaacuaugaccucgaac

SEQ ID NO: 1793 - RNA, 27 nt, Artificial Sequence
  Synthetic oligonucleotide
caccaacaggaacuaugaccucgaccc

SEQ ID NO: 1794 - RNA, 27 nt, Artificial Sequence
  Synthetic oligonucleotide
accaacaggaacuaugaccucgacuca

SEQ ID NO: 1795 - RNA, 27 nt, Artificial Sequence
  Synthetic oligonucleotide
ccaacaggaacuaugaccucgacuaaa

SEQ ID NO: 1796 - RNA, 27 nt, Artificial Sequence
  Synthetic oligonucleotide
caacaggaacuaugaccucgacuacac

SEQ ID NO: 1797 - RNA, 27 nt, Artificial Sequence
  Synthetic oligonucleotide
aacaggaacuaugaccucgacuacgca

SEQ ID NO: 1798 - RNA, 27 nt, Artificial Sequence
  Synthetic oligonucleotide
acaggaacuaugaccucgacuacgaac

SEQ ID NO: 1799 - RNA, 27 nt, Artificial Sequence
  Synthetic oligonucleotide
caggaacuaugaccucgacuacgacca

SEQ ID NO: 1800 - RNA, 27 nt, Artificial Sequence
  Synthetic oligonucleotide
aggaacuaugaccucgacuacgacuaa

SEQ ID NO: 1801 - RNA, 27 nt, Artificial Sequence
  Synthetic oligonucleotide
ggaacuaugaccucgacuacgacucaa

SEQ ID NO: 1802 - RNA, 27 nt, Artificial Sequence
  Synthetic oligonucleotide
gaacuaugaccucgacuacgacucgac

SEQ ID NO: 1803 - RNA, 27 nt, Artificial Sequence
  Synthetic oligonucleotide
aacuaugaccucgacuacgacucggca

SEQ ID NO: 1804 - RNA, 27 nt, Artificial Sequence
  Synthetic oligonucleotide
acuaugaccucgacuacgacucgguaa

SEQ ID NO: 1805 - RNA, 27 nt, Artificial Sequence
  Synthetic oligonucleotide
cuaugaccucgacuacgacucggugac

SEQ ID NO: 1806 - RNA, 27 nt, Artificial Sequence
  Synthetic oligonucleotide
gcgaggauaucuggaagaaauucgaaa

SEQ ID NO: 1807 - RNA, 27 nt, Artificial Sequence
  Synthetic oligonucleotide
cgaggauaucuggaagaaauucgagac

SEQ ID NO: 1808 - RNA, 27 nt, Artificial Sequence
  Synthetic oligonucleotide
gaggauaucuggaagaaauucgagcca

SEQ ID NO: 1809 - RNA, 27 nt, Artificial Sequence
  Synthetic oligonucleotide
aggauaucuggaagaaauucgagcuaa

SEQ ID NO: 1810 - RNA, 27 nt, Artificial Sequence
  Synthetic oligonucleotide
ggauaucuggaagaaauucgagcugac

SEQ ID NO: 1811 - RNA, 27 nt, Artificial Sequence
  Synthetic oligonucleotide
gauaucuggaagaaauucgagcugcca

SEQ ID NO: 1812 - RNA, 27 nt, Artificial Sequence
  Synthetic oligonucleotide
auaucuggaagaaauucgagcugcuaa

SEQ ID NO: 1813 - RNA, 27 nt, Artificial Sequence
  Synthetic oligonucleotide
uaucuggaagaaauucgagcugcugaa

SEQ ID NO: 1814 - RNA, 27 nt, Artificial Sequence
  Synthetic oligonucleotide
aucuggaagaaauucgagcugcugcaa

SEQ ID NO: 1815 - RNA, 27 nt, Artificial Sequence
  Synthetic oligonucleotide
ucuggaagaaauucgagcugcugccac

SEQ ID NO: 1816 - RNA, 27 nt, Artificial Sequence
  Synthetic oligonucleotide
cuggaagaaauucgagcugcugcccca

SEQ ID NO: 1817 - RNA, 27 nt, Artificial Sequence
  Synthetic oligonucleotide
cuagccgccgcuccgggcucugcucaa

SEQ ID NO: 1818 - RNA, 27 nt, Artificial Sequence
  Synthetic oligonucleotide
uagccgccgcuccgggcucugcucgaa

SEQ ID NO: 1819 - RNA, 27 nt, Artificial Sequence
  Synthetic oligonucleotide
agccgccgcuccgggcucugcucgcaa

SEQ ID NO: 1820 - RNA, 27 nt, Artificial Sequence
  Synthetic oligonucleotide
gccgccgcuccgggcucugcucgccac

SEQ ID NO: 1821 - RNA, 27 nt, Artificial Sequence
  Synthetic oligonucleotide
ccgccgcuccgggcucugcucgcccca

SEQ ID NO: 1822 - RNA, 27 nt, Artificial Sequence
  Synthetic oligonucleotide
ugggaggagacauggugaaccagagcc

SEQ ID NO: 1823 - RNA, 27 nt, Artificial Sequence
  Synthetic oligonucleotide
gggaggagacauggugaaccagagucc

SEQ ID NO: 1824 - RNA, 27 nt, Artificial Sequence
  Synthetic oligonucleotide
ggaggagacauggugaaccagaguuca

SEQ ID NO: 1825 - RNA, 27 nt, Artificial Sequence
  Synthetic oligonucleotide
gaggagacauggugaaccagaguuuac

SEQ ID NO: 1826 - RNA, 27 nt, Artificial Sequence
  Synthetic oligonucleotide
aggagacauggugaaccagaguuuccc

SEQ ID NO: 1827 - RNA, 27 nt, Artificial Sequence
  Synthetic oligonucleotide
cggacgacgagaccuucaucaaaaaac

SEQ ID NO: 1828 - RNA, 27 nt, Artificial Sequence
  Synthetic oligonucleotide
ggacgacgagaccuucaucaaaaaccc

SEQ ID NO: 1829 - RNA, 27 nt, Artificial Sequence
  Synthetic oligonucleotide
aaaacaucaucauccaggacuguauac

SEQ ID NO: 1830 - RNA, 27 nt, Artificial Sequence
  Synthetic oligonucleotide
aaacaucaucauccaggacuguaugca

SEQ ID NO: 1831 - RNA, 27 nt, Artificial Sequence
  Synthetic oligonucleotide
aacaucaucauccaggacuguauguaa

SEQ ID NO: 1832 - RNA, 27 nt, Artificial Sequence
  Synthetic oligonucleotide
acaucaucauccaggacuguaugugac

SEQ ID NO: 1833 - RNA, 27 nt, Artificial Sequence
  Synthetic oligonucleotide
caucaucauccaggacuguauguggca

SEQ ID NO: 1834 - RNA, 27 nt, Artificial Sequence
  Synthetic oligonucleotide
aucaucauccaggacuguauguggaaa

SEQ ID NO: 1835 - RNA, 27 nt, Artificial Sequence
  Synthetic oligonucleotide
ucaucauccaggacuguauguggagaa

SEQ ID NO: 1836 - RNA, 27 nt, Artificial Sequence
  Synthetic oligonucleotide
caucauccaggacuguauguggagcaa

SEQ ID NO: 1837 - RNA, 27 nt, Artificial Sequence
  Synthetic oligonucleotide
aucauccaggacuguauguggagcgaa

SEQ ID NO: 1838 - RNA, 27 nt, Artificial Sequence
  Synthetic oligonucleotide
ucauccaggacuguauguggagcggac

SEQ ID NO: 1839 - RNA, 27 nt, Artificial Sequence
  Synthetic oligonucleotide
cauccaggacuguauguggagcggccc

SEQ ID NO: 1840 - RNA, 27 nt, Artificial Sequence
  Synthetic oligonucleotide
auccaggacuguauguggagcggcuca

SEQ ID NO: 1841 - RNA, 27 nt, Artificial Sequence
  Synthetic oligonucleotide
uccaggacuguauguggagcggcuuac

SEQ ID NO: 1842 - RNA, 27 nt, Artificial Sequence
  Synthetic oligonucleotide
ccaggacuguauguggagcggcuucca

SEQ ID NO: 1843 - RNA, 27 nt, Artificial Sequence
  Synthetic oligonucleotide
cagagaagcuggccuccuaccaggcca

SEQ ID NO: 1844 - RNA, 27 nt, Artificial Sequence
  Synthetic oligonucleotide
agagaagcuggccuccuaccaggcuaa

SEQ ID NO: 1845 - RNA, 27 nt, Artificial Sequence
  Synthetic oligonucleotide
gagaagcuggccuccuaccaggcugaa

SEQ ID NO: 1846 - RNA, 27 nt, Artificial Sequence
  Synthetic oligonucleotide
agaagcuggccuccuaccaggcugcaa

SEQ ID NO: 1847 - RNA, 27 nt, Artificial Sequence
  Synthetic oligonucleotide
gaagcuggccuccuaccaggcugcgaa

SEQ ID NO: 1848 - RNA, 27 nt, Artificial Sequence
  Synthetic oligonucleotide
aagcuggccuccuaccaggcugcgcaa

SEQ ID NO: 1849 - RNA, 27 nt, Artificial Sequence
  Synthetic oligonucleotide
agcuggccuccuaccaggcugcgcgac

SEQ ID NO: 1850 - RNA, 27 nt, Artificial Sequence
  Synthetic oligonucleotide
gcuggccuccuaccaggcugcgcgccc

SEQ ID NO: 1851 - RNA, 27 nt, Artificial Sequence
  Synthetic oligonucleotide
cuggccuccuaccaggcugcgcgcacc

SEQ ID NO: 1852 - RNA, 27 nt, Artificial Sequence
  Synthetic oligonucleotide
uggccuccuaccaggcugcgcgcaaca

SEQ ID NO: 1853 - RNA, 27 nt, Artificial Sequence
  Synthetic oligonucleotide
ggccuccuaccaggcugcgcgcaaaac

SEQ ID NO: 1854 - RNA, 27 nt, Artificial Sequence
  Synthetic oligonucleotide
gccuccuaccaggcugcgcgcaaagca

SEQ ID NO: 1855 - RNA, 27 nt, Artificial Sequence
  Synthetic oligonucleotide
ccuccuaccaggcugcgcgcaaagaac

SEQ ID NO: 1856 - RNA, 27 nt, Artificial Sequence
  Synthetic oligonucleotide
cuccuaccaggcugcgcgcaaagacca

SEQ ID NO: 1857 - RNA, 27 nt, Artificial Sequence
  Synthetic oligonucleotide
uccuaccaggcugcgcgcaaagacaaa

SEQ ID NO: 1858 - RNA, 27 nt, Artificial Sequence
  Synthetic oligonucleotide
ccuaccaggcugcgcgcaaagacagaa

SEQ ID NO: 1859 - RNA, 27 nt, Artificial Sequence
  Synthetic oligonucleotide
cuaccaggcugcgcgcaaagacagcaa

SEQ ID NO: 1860 - RNA, 27 nt, Artificial Sequence
  Synthetic oligonucleotide
uaccaggcugcgcgcaaagacagcgaa

SEQ ID NO: 1861 - RNA, 27 nt, Artificial Sequence
  Synthetic oligonucleotide
accaggcugcgcgcaaagacagcggac

SEQ ID NO: 1862 - RNA, 27 nt, Artificial Sequence
  Synthetic oligonucleotide
ccaggcugcgcgcaaagacagcggcca

SEQ ID NO: 1863 - RNA, 27 nt, Artificial Sequence
  Synthetic oligonucleotide
caggcugcgcgcaaagacagcggcaaa

SEQ ID NO: 1864 - RNA, 27 nt, Artificial Sequence
  Synthetic oligonucleotide
gccacagcgucugcuccaccuccagac

SEQ ID NO: 1865 - RNA, 27 nt, Artificial Sequence
  Synthetic oligonucleotide
ccacagcgucugcuccaccuccagccc

SEQ ID NO: 1866 - RNA, 27 nt, Artificial Sequence
  Synthetic oligonucleotide
cacagcgucugcuccaccuccagcuca

SEQ ID NO: 1867 - RNA, 27 nt, Artificial Sequence
  Synthetic oligonucleotide
acagcgucugcuccaccuccagcuuac

SEQ ID NO: 1868 - RNA, 27 nt, Artificial Sequence
  Synthetic oligonucleotide
cagcgucugcuccaccuccagcuugcc

SEQ ID NO: 1869 - RNA, 27 nt, Artificial Sequence
  Synthetic oligonucleotide
agcgucugcuccaccuccagcuuguca

SEQ ID NO: 1870 - RNA, 27 nt, Artificial Sequence
  Synthetic oligonucleotide
cucucaacgacagcagcucgcccaaac

SEQ ID NO: 1871 - RNA, 27 nt, Artificial Sequence
  Synthetic oligonucleotide
ucucaacgacagcagcucgcccaagca

SEQ ID NO: 1872 - RNA, 27 nt, Artificial Sequence
  Synthetic oligonucleotide
cucaacgacagcagcucgcccaaguaa

SEQ ID NO: 1873 - RNA, 27 nt, Artificial Sequence
  Synthetic oligonucleotide
ucaacgacagcagcucgcccaagucac

SEQ ID NO: 1874 - RNA, 27 nt, Artificial Sequence
  Synthetic oligonucleotide
caacgacagcagcucgcccaaguccca

SEQ ID NO: 1875 - RNA, 27 nt, Artificial Sequence
  Synthetic oligonucleotide
uccaugaggagacaccgcccaccacac

SEQ ID NO: 1876 - RNA, 27 nt, Artificial Sequence
  Synthetic oligonucleotide
ccaugaggagacaccgcccaccaccca

SEQ ID NO: 1877 - RNA, 27 nt, Artificial Sequence
  Synthetic oligonucleotide
caugaggagacaccgcccaccaccaaa

SEQ ID NO: 1878 - RNA, 27 nt, Artificial Sequence
  Synthetic oligonucleotide
augaggagacaccgcccaccaccagac

SEQ ID NO: 1879 - RNA, 27 nt, Artificial Sequence
  Synthetic oligonucleotide
ugaggagacaccgcccaccaccagcca

SEQ ID NO: 1880 - RNA, 27 nt, Artificial Sequence
  Synthetic oligonucleotide
gaggagacaccgcccaccaccagcaaa

SEQ ID NO: 1881 - RNA, 27 nt, Artificial Sequence
  Synthetic oligonucleotide
aggagacaccgcccaccaccagcagaa

SEQ ID NO: 1882 - RNA, 27 nt, Artificial Sequence
  Synthetic oligonucleotide
ggagacaccgcccaccaccagcagcac

SEQ ID NO: 1883 - RNA, 27 nt, Artificial Sequence
  Synthetic oligonucleotide
gagacaccgcccaccaccagcagcgca

SEQ ID NO: 1884 - RNA, 27 nt, Artificial Sequence
  Synthetic oligonucleotide
agacaccgcccaccaccagcagcgaac

SEQ ID NO: 1885 - RNA, 27 nt, Artificial Sequence
  Synthetic oligonucleotide
gacaccgcccaccaccagcagcgacca

SEQ ID NO: 1886 - RNA, 27 nt, Artificial Sequence
  Synthetic oligonucleotide
acaccgcccaccaccagcagcgacuac

SEQ ID NO: 1887 - RNA, 27 nt, Artificial Sequence
  Synthetic oligonucleotide
caccgcccaccaccagcagcgacucca

SEQ ID NO: 1888 - RNA, 27 nt, Artificial Sequence
  Synthetic oligonucleotide
accgcccaccaccagcagcgacucuac

SEQ ID NO: 1889 - RNA, 27 nt, Artificial Sequence
  Synthetic oligonucleotide
ccgcccaccaccagcagcgacucugca

SEQ ID NO: 1890 - RNA, 27 nt, Artificial Sequence
  Synthetic oligonucleotide
cgcccaccaccagcagcgacucugaaa

SEQ ID NO: 1891 - RNA, 27 nt, Artificial Sequence
  Synthetic oligonucleotide
gcccaccaccagcagcgacucugagac

SEQ ID NO: 1892 - RNA, 27 nt, Artificial Sequence
  Synthetic oligonucleotide
cccaccaccagcagcgacucugaggca

SEQ ID NO: 1893 - RNA, 27 nt, Artificial Sequence
  Synthetic oligonucleotide
ccaccaccagcagcgacucugaggaaa

SEQ ID NO: 1894 - RNA, 27 nt, Artificial Sequence
  Synthetic oligonucleotide
caccaccagcagcgacucugaggagac

SEQ ID NO: 1895 - RNA, 27 nt, Artificial Sequence
  Synthetic oligonucleotide
aacaagaagaugaggaagaaaucgaca

SEQ ID NO: 1896 - RNA, 27 nt, Artificial Sequence
  Synthetic oligonucleotide
acaagaagaugaggaagaaaucgauac

SEQ ID NO: 1897 - RNA, 27 nt, Artificial Sequence
  Synthetic oligonucleotide
uggaggccacagcaaaccuccucacca

SEQ ID NO: 1898 - RNA, 27 nt, Artificial Sequence
  Synthetic oligonucleotide
cucacagcccacugguccucaagagac

SEQ ID NO: 1899 - RNA, 27 nt, Artificial Sequence
  Synthetic oligonucleotide
ucacagcccacugguccucaagaggca

SEQ ID NO: 1900 - RNA, 27 nt, Artificial Sequence
  Synthetic oligonucleotide
cacagcccacugguccucaagagguaa

SEQ ID NO: 1901 - RNA, 27 nt, Artificial Sequence
  Synthetic oligonucleotide
acagcccacugguccucaagaggugaa

SEQ ID NO: 1902 - RNA, 27 nt, Artificial Sequence
  Synthetic oligonucleotide
cagcccacugguccucaagaggugcac

SEQ ID NO: 1903 - RNA, 27 nt, Artificial Sequence
  Synthetic oligonucleotide
agcccacugguccucaagaggugccca

SEQ ID NO: 1904 - RNA, 27 nt, Artificial Sequence
  Synthetic oligonucleotide
gcccacugguccucaagaggugccaaa

SEQ ID NO: 1905 - RNA, 27 nt, Artificial Sequence
  Synthetic oligonucleotide
cccacugguccucaagaggugccacac

SEQ ID NO: 1906 - RNA, 27 nt, Artificial Sequence
  Synthetic oligonucleotide
ccacugguccucaagaggugccacgca

SEQ ID NO: 1907 - RNA, 27 nt, Artificial Sequence
  Synthetic oligonucleotide
cacugguccucaagaggugccacguac

SEQ ID NO: 1908 - RNA, 27 nt, Artificial Sequence
  Synthetic oligonucleotide
acugguccucaagaggugccacgucca

SEQ ID NO: 1909 - RNA, 27 nt, Artificial Sequence
  Synthetic oligonucleotide
cugguccucaagaggugccacgucuaa

SEQ ID NO: 1910 - RNA, 27 nt, Artificial Sequence
  Synthetic oligonucleotide
ugguccucaagaggugccacgucucac

SEQ ID NO: 1911 - RNA, 27 nt, Artificial Sequence
  Synthetic oligonucleotide
gguccucaagaggugccacgucuccca

SEQ ID NO: 1912 - RNA, 27 nt, Artificial Sequence
  Synthetic oligonucleotide
guccucaagaggugccacgucuccaac

SEQ ID NO: 1913 - RNA, 27 nt, Artificial Sequence
  Synthetic oligonucleotide
uccucaagaggugccacgucuccacca

SEQ ID NO: 1914 - RNA, 27 nt, Artificial Sequence
  Synthetic oligonucleotide
ggagcuuuuuugcccugcgugaccaac

SEQ ID NO: 1915 - RNA, 27 nt, Artificial Sequence
  Synthetic oligonucleotide
gagcuuuuuugcccugcgugaccagcc

SEQ ID NO: 1916 - RNA, 27 nt, Artificial Sequence
  Synthetic oligonucleotide
agcuuuuuugcccugcgugaccagaca

SEQ ID NO: 1917 - RNA, 27 nt, Artificial Sequence
  Synthetic oligonucleotide
gcuuuuuugcccugcgugaccagauaa

SEQ ID NO: 1918 - RNA, 27 nt, Artificial Sequence
  Synthetic oligonucleotide
cuuuuuugcccugcgugaccagaucaa

SEQ ID NO: 1919 - RNA, 27 nt, Artificial Sequence
  Synthetic oligonucleotide
uuuuuugcccugcgugaccagauccaa

SEQ ID NO: 1920 - RNA, 27 nt, Artificial Sequence
  Synthetic oligonucleotide
uuuuugcccugcgugaccagaucccaa

SEQ ID NO: 1921 - RNA, 27 nt, Artificial Sequence
  Synthetic oligonucleotide
uuuugcccugcgugaccagaucccgac

SEQ ID NO: 1922 - RNA, 27 nt, Artificial Sequence
  Synthetic oligonucleotide
uuugcccugcgugaccagaucccggca

SEQ ID NO: 1923 - RNA, 27 nt, Artificial Sequence
  Synthetic oligonucleotide
uugcccugcgugaccagaucccggaac

SEQ ID NO: 1924 - RNA, 27 nt, Artificial Sequence
  Synthetic oligonucleotide
ugcccugcgugaccagaucccggagcc

SEQ ID NO: 1925 - RNA, 27 nt, Artificial Sequence
  Synthetic oligonucleotide
gcggaaacgacgagaacaguugaaaac

SEQ ID NO: 1926 - RNA, 27 nt, Artificial Sequence
  Synthetic oligonucleotide
cggaaacgacgagaacaguugaaacca

SEQ ID NO: 1927 - RNA, 27 nt, Artificial Sequence
  Synthetic oligonucleotide
ucuuuaacagauuuguauuuaagaacc

SEQ ID NO: 1928 - RNA, 27 nt, Artificial Sequence
  Synthetic oligonucleotide
cuuuaacagauuuguauuuaagaauca

SEQ ID NO: 1929 - RNA, 27 nt, Artificial Sequence
  Synthetic oligonucleotide
uuaaauguaaauaacuuuaauaaaaaa

SEQ ID NO: 1930 - RNA, 27 nt, Artificial Sequence
  Synthetic oligonucleotide
uaaauguaaauaacuuuaauaaaacac

SEQ ID NO: 1931 - RNA, 27 nt, Artificial Sequence
  Synthetic oligonucleotide
aaauguaaauaacuuuaauaaaacgcc

SEQ ID NO: 1932 - RNA, 27 nt, Artificial Sequence
  Synthetic oligonucleotide
aauguaaauaacuuuaauaaaacgucc

SEQ ID NO: 1933 - RNA, 27 nt, Artificial Sequence
  Synthetic oligonucleotide
auguaaauaacuuuaauaaaacguucc

SEQ ID NO: 1934 - RNA, 27 nt, Artificial Sequence
  Synthetic oligonucleotide
uguaaauaacuuuaauaaaacguuucc

SEQ ID NO: 1935 - RNA, 27 nt, Artificial Sequence
  Synthetic oligonucleotide
guaaauaacuuuaauaaaacguuuacc

SEQ ID NO: 1936 - RNA, 27 nt, Artificial Sequence
  Synthetic oligonucleotide
uaaauaacuuuaauaaaacguuuauca

SEQ ID NO: 1937 - RNA, 27 nt, Artificial Sequence
  Synthetic oligonucleotide
aaauaacuuuaauaaaacguuuauaaa

SEQ ID NO: 1938 - RNA, 27 nt, Artificial Sequence
  Synthetic oligonucleotide
aauaacuuuaauaaaacguuuauagac

SEQ ID NO: 1939 - RNA, 27 nt, Artificial Sequence
  Synthetic oligonucleotide
auaacuuuaauaaaacguuuauagcca

SEQ ID NO: 1940 - RNA, 27 nt, Artificial Sequence
  Synthetic oligonucleotide
uaacuuuaauaaaacguuuauagcaac

SEQ ID NO: 1941 - RNA, 27 nt, Artificial Sequence
  Synthetic oligonucleotide
aacuuuaauaaaacguuuauagcagcc

SEQ ID NO: 1942 - RNA, 27 nt, Artificial Sequence
  Synthetic oligonucleotide
gcuuuuuaaaguugauuuuuuucuacc

SEQ ID NO: 1943 - RNA, 27 nt, Artificial Sequence
  Synthetic oligonucleotide
cuuuuuaaaguugauuuuuuucuauca

SEQ ID NO: 1944 - RNA, 27 nt, Artificial Sequence
  Synthetic oligonucleotide
uuuuuaaaguugauuuuuuucuauuac

SEQ ID NO: 1945 - RNA, 27 nt, Artificial Sequence
  Synthetic oligonucleotide
uuuuaaaguugauuuuuuucuauugcc

SEQ ID NO: 1946 - RNA, 27 nt, Artificial Sequence
  Synthetic oligonucleotide
uuuaaaguugauuuuuuucuauugucc

SEQ ID NO: 1947 - RNA, 27 nt, Artificial Sequence
  Synthetic oligonucleotide
uuaaaguugauuuuuuucuauuguucc

SEQ ID NO: 1948 - RNA, 27 nt, Artificial Sequence
  Synthetic oligonucleotide
uaaaguugauuuuuuucuauuguuucc

SEQ ID NO: 1949 - RNA, 27 nt, Artificial Sequence
  Synthetic oligonucleotide
aaaguugauuuuuuucuauuguuuucc

SEQ ID NO: 1950 - RNA, 27 nt, Artificial Sequence
  Synthetic oligonucleotide
aaguugauuuuuuucuauuguuuuuca

SEQ ID NO: 1951 - RNA, 27 nt, Artificial Sequence
  Synthetic oligonucleotide
aguugauuuuuuucuauuguuuuuaac

SEQ ID NO: 1952 - RNA, 27 nt, Artificial Sequence
  Synthetic oligonucleotide
guugauuuuuuucuauuguuuuuagcc

SEQ ID NO: 1953 - RNA, 27 nt, Artificial Sequence
  Synthetic oligonucleotide
uugauuuuuuucuauuguuuuuagacc

SEQ ID NO: 1954 - RNA, 27 nt, Artificial Sequence
  Synthetic oligonucleotide
ugauuuuuuucuauuguuuuuagaacc

SEQ ID NO: 1955 - RNA, 27 nt, Artificial Sequence
  Synthetic oligonucleotide
gauuuuuuucuauuguuuuuagaaacc

SEQ ID NO: 1956 - RNA, 27 nt, Artificial Sequence
  Synthetic oligonucleotide
auuuuuuucuauuguuuuuagaaaacc

SEQ ID NO: 1957 - RNA, 27 nt, Artificial Sequence
  Synthetic oligonucleotide
uuuuuuucuauuguuuuuagaaaaacc

SEQ ID NO: 1958 - RNA, 27 nt, Artificial Sequence
  Synthetic oligonucleotide
uuuuuucuauuguuuuuagaaaaaacc

SEQ ID NO: 1959 - RNA, 27 nt, Artificial Sequence
  Synthetic oligonucleotide
uuuuucuauuguuuuuagaaaaaaucc

SEQ ID NO: 1960 - RNA, 27 nt, Artificial Sequence
  Synthetic oligonucleotide
uuuucuauuguuuuuagaaaaaauacc

SEQ ID NO: 1961 - RNA, 27 nt, Artificial Sequence
  Synthetic oligonucleotide
uuucuauuguuuuuagaaaaaauaacc

SEQ ID NO: 1962 - RNA, 27 nt, Artificial Sequence
  Synthetic oligonucleotide
uucuauuguuuuuagaaaaaauaaacc

SEQ ID NO: 1963 - RNA, 27 nt, Artificial Sequence
  Synthetic oligonucleotide
cucgagaagggcagggcuucucagagg

SEQ ID NO: 1964 - RNA, 27 nt, Artificial Sequence
  Synthetic oligonucleotide
gggcuuuaucuaacucgcuguaguaau

SEQ ID NO: 1965 - RNA, 27 nt, Artificial Sequence
  Synthetic oligonucleotide
aacccuugccgcauccacgaaacuuug

SEQ ID NO: 1966 - RNA, 27 nt, Artificial Sequence
  Synthetic oligonucleotide
uugccgcauccacgaaacuuugcccau

SEQ ID NO: 1967 - RNA, 27 nt, Artificial Sequence
  Synthetic oligonucleotide
cauccacgaaacuuugcccauagcagc

SEQ ID NO: 1968 - RNA, 27 nt, Artificial Sequence
  Synthetic oligonucleotide
gggcgggcacuuugcacuggaacuuac

SEQ ID NO: 1969 - RNA, 27 nt, Artificial Sequence
  Synthetic oligonucleotide
gcacuuugcacuggaacuuacaacacc

SEQ ID NO: 1970 - RNA, 27 nt, Artificial Sequence
  Synthetic oligonucleotide
cacuggaacuuacaacacccgagcaag

SEQ ID NO: 1971 - RNA, 27 nt, Artificial Sequence
  Synthetic oligonucleotide
uugcagcugcuuagacgcuggauuuuu

SEQ ID NO: 1972 - RNA, 27 nt, Artificial Sequence
  Synthetic oligonucleotide
cugcuuagacgcuggauuuuuuucggg

SEQ ID NO: 1973 - RNA, 27 nt, Artificial Sequence
  Synthetic oligonucleotide
gacgcuggauuuuuuucggguagugga

SEQ ID NO: 1974 - RNA, 27 nt, Artificial Sequence
  Synthetic oligonucleotide
uggauuuuuuucggguaguggaaaacc

SEQ ID NO: 1975 - RNA, 27 nt, Artificial Sequence
  Synthetic oligonucleotide
uucggguaguggaaaaccagcagccuc

SEQ ID NO: 1976 - RNA, 27 nt, Artificial Sequence
  Synthetic oligonucleotide
cccucaacguuagcuucaccaacagga

SEQ ID NO: 1977 - RNA, 27 nt, Artificial Sequence
  Synthetic oligonucleotide
acguuagcuucaccaacaggaacuaug

SEQ ID NO: 1978 - RNA, 27 nt, Artificial Sequence
  Synthetic oligonucleotide
acgacucggugcagccguauuucuacu

SEQ ID NO: 1979 - RNA, 27 nt, Artificial Sequence
  Synthetic oligonucleotide
gugcagccguauuucuacugcgacgag

SEQ ID NO: 1980 - RNA, 27 nt, Artificial Sequence
  Synthetic oligonucleotide
aggaggagaacuucuaccagcagcagc

SEQ ID NO: 1981 - RNA, 27 nt, Artificial Sequence
  Synthetic oligonucleotide
cagcgaggauaucuggaagaaauucga

SEQ ID NO: 1982 - RNA, 27 nt, Artificial Sequence
  Synthetic oligonucleotide
uacguugcggucacacccuucucccuu

SEQ ID NO: 1983 - RNA, 27 nt, Artificial Sequence
  Synthetic oligonucleotide
agacauggugaaccagaguuucaucug

SEQ ID NO: 1984 - RNA, 27 nt, Artificial Sequence
  Synthetic oligonucleotide
acccggacgacgagaccuucaucaaaa

SEQ ID NO: 1985 - RNA, 27 nt, Artificial Sequence
  Synthetic oligonucleotide
acgagaccuucaucaaaaacaucauca

SEQ ID NO: 1986 - RNA, 27 nt, Artificial Sequence
  Synthetic oligonucleotide
ucaaaaacaucaucauccaggacugua

SEQ ID NO: 1987 - RNA, 27 nt, Artificial Sequence
  Synthetic oligonucleotide
caggacuguauguggagcggcuucucg

SEQ ID NO: 1988 - RNA, 27 nt, Artificial Sequence
  Synthetic oligonucleotide
gucugcuccaccuccagcuuguaccug

SEQ ID NO: 1989 - RNA, 27 nt, Artificial Sequence
  Synthetic oligonucleotide
ccaccuccagcuuguaccugcaggauc

SEQ ID NO: 1990 - RNA, 27 nt, Artificial Sequence
  Synthetic oligonucleotide
uccagcuuguaccugcaggaucugagc

SEQ ID NO: 1991 - RNA, 27 nt, Artificial Sequence
  Synthetic oligonucleotide
ccaaguccugcgccucgcaagacucca

SEQ ID NO: 1992 - RNA, 27 nt, Artificial Sequence
  Synthetic oligonucleotide
cagcagcgacucugaggaggaacaaga

SEQ ID NO: 1993 - RNA, 27 nt, Artificial Sequence
  Synthetic oligonucleotide
cgacucugaggaggaacaagaagauga

SEQ ID NO: 1994 - RNA, 27 nt, Artificial Sequence
  Synthetic oligonucleotide
cugaggaggaacaagaagaugaggaag

SEQ ID NO: 1995 - RNA, 27 nt, Artificial Sequence
  Synthetic oligonucleotide
ggaacaagaagaugaggaagaaaucga

SEQ ID NO: 1996 - RNA, 27 nt, Artificial Sequence
  Synthetic oligonucleotide
agaagaugaggaagaaaucgauguugu

SEQ ID NO: 1997 - RNA, 27 nt, Artificial Sequence
  Synthetic oligonucleotide
ugaggaagaaaucgauguuguuucugu

SEQ ID NO: 1998 - RNA, 27 nt, Artificial Sequence
  Synthetic oligonucleotide
agaaaucgauguuguuucuguggaaaa

SEQ ID NO: 1999 - RNA, 27 nt, Artificial Sequence
  Synthetic oligonucleotide
cgauguuguuucuguggaaaagaggca

SEQ ID NO: 2000 - RNA, 27 nt, Artificial Sequence
  Synthetic oligonucleotide
aagaggcaggcuccuggcaaaagguca

SEQ ID NO: 2001 - RNA, 27 nt, Artificial Sequence
  Synthetic oligonucleotide
gcaggcuccuggcaaaaggucagaguc

SEQ ID NO: 2002 - RNA, 27 nt, Artificial Sequence
  Synthetic oligonucleotide
cuccuggcaaaaggucagagucuggau

SEQ ID NO: 2003 - RNA, 27 nt, Artificial Sequence
  Synthetic oligonucleotide
ggcaaaaggucagagucuggaucaccu

SEQ ID NO: 2004 - RNA, 27 nt, Artificial Sequence
  Synthetic oligonucleotide
aaggucagagucuggaucaccuucugc

SEQ ID NO: 2005 - RNA, 27 nt, Artificial Sequence
  Synthetic oligonucleotide
cagcaaaccuccucacagcccacuggu

SEQ ID NO: 2006 - RNA, 27 nt, Artificial Sequence
  Synthetic oligonucleotide
cuccucacagcccacugguccucaaga

SEQ ID NO: 2007 - RNA, 27 nt, Artificial Sequence
  Synthetic oligonucleotide
cucccuccacucggaaggacuauccug

SEQ ID NO: 2008 - RNA, 27 nt, Artificial Sequence
  Synthetic oligonucleotide
cacucggaaggacuauccugcugccaa

SEQ ID NO: 2009 - RNA, 27 nt, Artificial Sequence
  Synthetic oligonucleotide
cuauccugcugccaagagggucaaguu

SEQ ID NO: 2010 - RNA, 27 nt, Artificial Sequence
  Synthetic oligonucleotide
cugcugccaagagggucaaguuggaca

SEQ ID NO: 2011 - RNA, 27 nt, Artificial Sequence
  Synthetic oligonucleotide
gccaagagggucaaguuggacaguguc

SEQ ID NO: 2012 - RNA, 27 nt, Artificial Sequence
  Synthetic oligonucleotide
gagggucaaguuggacagugucagagu

SEQ ID NO: 2013 - RNA, 27 nt, Artificial Sequence
  Synthetic oligonucleotide
ucaaguuggacagugucagaguccuga

SEQ ID NO: 2014 - RNA, 27 nt, Artificial Sequence
  Synthetic oligonucleotide
uuggacagugucagaguccugagacag

SEQ ID NO: 2015 - RNA, 27 nt, Artificial Sequence
  Synthetic oligonucleotide
gucagaguccugagacagaucagcaac

SEQ ID NO: 2016 - RNA, 27 nt, Artificial Sequence
  Synthetic oligonucleotide
cugagacagaucagcaacaaccgaaaa

SEQ ID NO: 2017 - RNA, 27 nt, Artificial Sequence
  Synthetic oligonucleotide
cagaucagcaacaaccgaaaaugcacc

SEQ ID NO: 2018 - RNA, 27 nt, Artificial Sequence
  Synthetic oligonucleotide
guccucggacaccgaggagaaugucaa

SEQ ID NO: 2019 - RNA, 27 nt, Artificial Sequence
  Synthetic oligonucleotide
cggacaccgaggagaaugucaagaggc

SEQ ID NO: 2020 - RNA, 27 nt, Artificial Sequence
  Synthetic oligonucleotide
gccagaggaggaacgagcuaaaacgga

SEQ ID NO: 2021 - RNA, 27 nt, Artificial Sequence
  Synthetic oligonucleotide
ggaggaacgagcuaaaacggagcuuuu

SEQ ID NO: 2022 - RNA, 27 nt, Artificial Sequence
  Synthetic oligonucleotide
aacgagcuaaaacggagcuuuuuugcc

SEQ ID NO: 2023 - RNA, 27 nt, Artificial Sequence
  Synthetic oligonucleotide
cuaaaacggagcuuuuuugcccugcgu

SEQ ID NO: 2024 - RNA, 27 nt, Artificial Sequence
  Synthetic oligonucleotide
acggagcuuuuuugcccugcgugacca

SEQ ID NO: 2025 - RNA, 27 nt, Artificial Sequence
  Synthetic oligonucleotide
gugaccagaucccggaguuggaaaaca

SEQ ID NO: 2026 - RNA, 27 nt, Artificial Sequence
  Synthetic oligonucleotide
cagaucccggaguuggaaaacaaugaa

SEQ ID NO: 2027 - RNA, 27 nt, Artificial Sequence
  Synthetic oligonucleotide
cccggaguuggaaaacaaugaaaaggc

SEQ ID NO: 2028 - RNA, 27 nt, Artificial Sequence
  Synthetic oligonucleotide
caagguaguuauccuuaaaaaagccac

SEQ ID NO: 2029 - RNA, 27 nt, Artificial Sequence
  Synthetic oligonucleotide
uaguuauccuuaaaaaagccacagcau

SEQ ID NO: 2030 - RNA, 27 nt, Artificial Sequence
  Synthetic oligonucleotide
auccuuaaaaaagccacagcauacauc

SEQ ID NO: 2031 - RNA, 27 nt, Artificial Sequence
  Synthetic oligonucleotide
uaaaaaagccacagcauacauccuguc

SEQ ID NO: 2032 - RNA, 27 nt, Artificial Sequence
  Synthetic oligonucleotide
aagccacagcauacauccuguccgucc

SEQ ID NO: 2033 - RNA, 27 nt, Artificial Sequence
  Synthetic oligonucleotide
cagcauacauccuguccguccaagcag

SEQ ID NO: 2034 - RNA, 27 nt, Artificial Sequence
  Synthetic oligonucleotide
auccuguccguccaagcagaggagcaa

SEQ ID NO: 2035 - RNA, 27 nt, Artificial Sequence
  Synthetic oligonucleotide
guccguccaagcagaggagcaaaagcu

SEQ ID NO: 2036 - RNA, 27 nt, Artificial Sequence
  Synthetic oligonucleotide
aagcagaggagcaaaagcucauuucug

SEQ ID NO: 2037 - RNA, 27 nt, Artificial Sequence
  Synthetic oligonucleotide
ggagcaaaagcucauuucugaagagga

SEQ ID NO: 2038 - RNA, 27 nt, Artificial Sequence
  Synthetic oligonucleotide
aaaagcucauuucugaagaggacuugu

SEQ ID NO: 2039 - RNA, 27 nt, Artificial Sequence
  Synthetic oligonucleotide
ucauuucugaagaggacuuguugcgga

SEQ ID NO: 2040 - RNA, 27 nt, Artificial Sequence
  Synthetic oligonucleotide
cugaagaggacuuguugcggaaacgac

SEQ ID NO: 2041 - RNA, 27 nt, Artificial Sequence
  Synthetic oligonucleotide
gaggacuuguugcggaaacgacgagaa

SEQ ID NO: 2042 - RNA, 27 nt, Artificial Sequence
  Synthetic oligonucleotide
cuuguugcggaaacgacgagaacaguu

SEQ ID NO: 2043 - RNA, 27 nt, Artificial Sequence
  Synthetic oligonucleotide
ugcggaaacgacgagaacaguugaaac

SEQ ID NO: 2044 - RNA, 27 nt, Artificial Sequence
  Synthetic oligonucleotide
acaaacuugaacagcuacggaacucuu

SEQ ID NO: 2045 - RNA, 27 nt, Artificial Sequence
  Synthetic oligonucleotide
uugaacagcuacggaacucuugugcgu

SEQ ID NO: 2046 - RNA, 27 nt, Artificial Sequence
  Synthetic oligonucleotide
cagcuacggaacucuugugcguaagga

SEQ ID NO: 2047 - RNA, 27 nt, Artificial Sequence
  Synthetic oligonucleotide
ggaacucuugugcguaaggaaaaguaa

SEQ ID NO: 2048 - RNA, 27 nt, Artificial Sequence
  Synthetic oligonucleotide
cuugugcguaaggaaaaguaaggaaaa

SEQ ID NO: 2049 - RNA, 27 nt, Artificial Sequence
  Synthetic oligonucleotide
gcguaaggaaaaguaaggaaaacgauu

SEQ ID NO: 2050 - RNA, 27 nt, Artificial Sequence
  Synthetic oligonucleotide
aaguaaggaaaacgauuccuucuaaca

SEQ ID NO: 2051 - RNA, 27 nt, Artificial Sequence
  Synthetic oligonucleotide
aggaaaacgauuccuucuaacagaaau

SEQ ID NO: 2052 - RNA, 27 nt, Artificial Sequence
  Synthetic oligonucleotide
aacgauuccuucuaacagaaauguccu

SEQ ID NO: 2053 - RNA, 27 nt, Artificial Sequence
  Synthetic oligonucleotide
uccuucuaacagaaauguccugagcaa

SEQ ID NO: 2054 - RNA, 27 nt, Artificial Sequence
  Synthetic oligonucleotide
aacagaaauguccugagcaaucaccua

SEQ ID NO: 2055 - RNA, 27 nt, Artificial Sequence
  Synthetic oligonucleotide
guccugagcaaucaccuaugaacuugu

SEQ ID NO: 2056 - RNA, 27 nt, Artificial Sequence
  Synthetic oligonucleotide
agcaaucaccuaugaacuuguuucaaa

SEQ ID NO: 2057 - RNA, 27 nt, Artificial Sequence
  Synthetic oligonucleotide
caccuaugaacuuguuucaaaugcaug

SEQ ID NO: 2058 - RNA, 27 nt, Artificial Sequence
  Synthetic oligonucleotide
augaacuuguuucaaaugcaugaucaa

SEQ ID NO: 2059 - RNA, 27 nt, Artificial Sequence
  Synthetic oligonucleotide
uuguuucaaaugcaugaucaaaugcaa

SEQ ID NO: 2060 - RNA, 27 nt, Artificial Sequence
  Synthetic oligonucleotide
ucaaaugcaugaucaaaugcaaccuca

SEQ ID NO: 2061 - RNA, 27 nt, Artificial Sequence
  Synthetic oligonucleotide
augaucaaaugcaaccucacaaccuug

SEQ ID NO: 2062 - RNA, 27 nt, Artificial Sequence
  Synthetic oligonucleotide
caaaugcaaccucacaaccuuggcuga

SEQ ID NO: 2063 - RNA, 27 nt, Artificial Sequence
  Synthetic oligonucleotide
aaccucacaaccuuggcugagucuuga

SEQ ID NO: 2064 - RNA, 27 nt, Artificial Sequence
  Synthetic oligonucleotide
cacaaccuuggcugagucuugagacug

SEQ ID NO: 2065 - RNA, 27 nt, Artificial Sequence
  Synthetic oligonucleotide
uuggcugagucuugagacugaaagauu

SEQ ID NO: 2066 - RNA, 27 nt, Artificial Sequence
  Synthetic oligonucleotide
gagucuugagacugaaagauuuagcca

SEQ ID NO: 2067 - RNA, 27 nt, Artificial Sequence
  Synthetic oligonucleotide
gagacugaaagauuuagccauaaugua

SEQ ID NO: 2068 - RNA, 27 nt, Artificial Sequence
  Synthetic oligonucleotide
ugaaagauuuagccauaauguaaacug

SEQ ID NO: 2069 - RNA, 27 nt, Artificial Sequence
  Synthetic oligonucleotide
uagccauaauguaaacugccucaaauu

SEQ ID NO: 2070 - RNA, 27 nt, Artificial Sequence
  Synthetic oligonucleotide
auguaaacugccucaaauuggacuuug

SEQ ID NO: 2071 - RNA, 27 nt, Artificial Sequence
  Synthetic oligonucleotide
acugccucaaauuggacuuugggcaua

SEQ ID NO: 2072 - RNA, 27 nt, Artificial Sequence
  Synthetic oligonucleotide
cucaaauuggacuuugggcauaaaaga

SEQ ID NO: 2073 - RNA, 27 nt, Artificial Sequence
  Synthetic oligonucleotide
uggacuuugggcauaaaagaacuuuuu

SEQ ID NO: 2074 - RNA, 27 nt, Artificial Sequence
  Synthetic oligonucleotide
ugggcauaaaagaacuuuuuuaugcuu

SEQ ID NO: 2075 - RNA, 27 nt, Artificial Sequence
  Synthetic oligonucleotide
auaaaagaacuuuuuuaugcuuaccau

SEQ ID NO: 2076 - RNA, 27 nt, Artificial Sequence
  Synthetic oligonucleotide
agaacuuuuuuaugcuuaccaucuuuu

SEQ ID NO: 2077 - RNA, 27 nt, Artificial Sequence
  Synthetic oligonucleotide
uuuuuaugcuuaccaucuuuuuuuuuu

SEQ ID NO: 2078 - RNA, 27 nt, Artificial Sequence
  Synthetic oligonucleotide
augcuuaccaucuuuuuuuuuucuuua

SEQ ID NO: 2079 - RNA, 27 nt, Artificial Sequence
  Synthetic oligonucleotide
uaccaucuuuuuuuuuucuuuaacaga

SEQ ID NO: 2080 - RNA, 27 nt, Artificial Sequence
  Synthetic oligonucleotide
cuuuuuuuuuucuuuaacagauuugua

SEQ ID NO: 2081 - RNA, 27 nt, Artificial Sequence
  Synthetic oligonucleotide
uucuuuaacagauuuguauuuaagaau

SEQ ID NO: 2082 - RNA, 27 nt, Artificial Sequence
  Synthetic oligonucleotide
aacagauuuguauuuaagaauuguuuu

SEQ ID NO: 2083 - RNA, 27 nt, Artificial Sequence
  Synthetic oligonucleotide
uguauuuaagaauuguuuuuaaaaaau

SEQ ID NO: 2084 - RNA, 27 nt, Artificial Sequence
  Synthetic oligonucleotide
aagaauuguuuuuaaaaaauuuuaaga

SEQ ID NO: 2085 - RNA, 27 nt, Artificial Sequence
  Synthetic oligonucleotide
acaauguuucucuguaaauauugccau

SEQ ID NO: 2086 - RNA, 27 nt, Artificial Sequence
  Synthetic oligonucleotide
cucuguaaauauugccauuaaauguaa

SEQ ID NO: 2087 - RNA, 27 nt, Artificial Sequence
  Synthetic oligonucleotide
uaaauauugccauuaaauguaaauaac

SEQ ID NO: 2088 - RNA, 27 nt, Artificial Sequence
  Synthetic oligonucleotide
ugccauuaaauguaaauaacuuuaaua

SEQ ID NO: 2089 - RNA, 27 nt, Artificial Sequence
  Synthetic oligonucleotide
cuuuaauaaaacguuuauagcaguuac

SEQ ID NO: 2090 - RNA, 27 nt, Artificial Sequence
  Synthetic oligonucleotide
cacagaauuucaauccuaguauauagu

SEQ ID NO: 2091 - RNA, 27 nt, Artificial Sequence
  Synthetic oligonucleotide
accuaguauuauagguacuauaaaccc

SEQ ID NO: 2092 - RNA, 27 nt, Artificial Sequence
  Synthetic oligonucleotide
auuauagguacuauaaacccuaauuuu

SEQ ID NO: 2093 - RNA, 27 nt, Artificial Sequence
  Synthetic oligonucleotide
guacuauaaacccuaauuuuuuuuauu

SEQ ID NO: 2094 - RNA, 27 nt, Artificial Sequence
  Synthetic oligonucleotide
aacccuaauuuuuuuuauuuaaguaca

SEQ ID NO: 2095 - RNA, 27 nt, Artificial Sequence
  Synthetic oligonucleotide
uaauuuuuuuuauuuaaguacauuuug

SEQ ID NO: 2096 - RNA, 27 nt, Artificial Sequence
  Synthetic oligonucleotide
uuuauuuaaguacauuuugcuuuuuaa

SEQ ID NO: 2097 - RNA, 27 nt, Artificial Sequence
  Synthetic oligonucleotide
uuaaguacauuuugcuuuuuaaaguug

SEQ ID NO: 2098 - RNA, 27 nt, Artificial Sequence
  Synthetic oligonucleotide
acauuuugcuuuuuaaaguugauuuuu

SEQ ID NO: 2099 - RNA, 27 nt, Artificial Sequence
  Synthetic oligonucleotide
ugcuuuuuaaaguugauuuuuuucuau

SEQ ID NO: 2100 - RNA, 27 nt, Artificial Sequence
  Synthetic oligonucleotide
ucuauuguuuuuagaaaaaauaaaaua

SEQ ID NO: 2101 - RNA, 27 nt, Artificial Sequence
  Synthetic oligonucleotide
uguuuuuagaaaaaauaaaauaacugg

SEQ ID NO: 2102 - RNA, 27 nt, Artificial Sequence
  Synthetic oligonucleotide
gaaaaaauaaaauaacuggcaaauaua

SEQ ID NO: 2103 - RNA, 27 nt, Artificial Sequence
  Synthetic oligonucleotide
aaaauaacuggcaaauauaucauugag

SEQ ID NO: 2104 - RNA, 27 nt, Artificial Sequence
  Synthetic oligonucleotide
ggcaaauauaucauugagccaaaucuu

SEQ ID NO: 2105 - RNA, 27 nt, Artificial Sequence
  Synthetic oligonucleotide
auaucauugagccaaaucuuaaaaaaa

SEQ ID NO: 2106 - RNA, 27 nt, Artificial Sequence
  Synthetic oligonucleotide
uugagccaaaucuuaaaaaaaaaaaaa

SEQ ID NO: 2107 - RNA, 27 nt, Artificial Sequence
  Synthetic oligonucleotide
uaacucgcuguaguaauuccagcgaga

SEQ ID NO: 2108 - RNA, 27 nt, Artificial Sequence
  Synthetic oligonucleotide
aacucgcuguaguaauuccagcgagag

SEQ ID NO: 2109 - RNA, 27 nt, Artificial Sequence
  Synthetic oligonucleotide
acucgcuguaguaauuccagcgagagg

SEQ ID NO: 2110 - RNA, 27 nt, Artificial Sequence
  Synthetic oligonucleotide
cucgcuguaguaauuccagcgagaggc

SEQ ID NO: 2111 - RNA, 27 nt, Artificial Sequence
  Synthetic oligonucleotide
ucgcuguaguaauuccagcgagaggca

SEQ ID NO: 2112 - RNA, 27 nt, Artificial Sequence
  Synthetic oligonucleotide
cgcuguaguaauuccagcgagaggcag

SEQ ID NO: 2113 - RNA, 27 nt, Artificial Sequence
  Synthetic oligonucleotide
gcuguaguaauuccagcgagaggcaga

SEQ ID NO: 2114 - RNA, 27 nt, Artificial Sequence
  Synthetic oligonucleotide
cuguaguaauuccagcgagaggcagag

SEQ ID NO: 2115 - RNA, 27 nt, Artificial Sequence
  Synthetic oligonucleotide
agcuucaccaacaggaacuaugaccuc

SEQ ID NO: 2116 - RNA, 27 nt, Artificial Sequence
  Synthetic oligonucleotide
gcuucaccaacaggaacuaugaccucg

SEQ ID NO: 2117 - RNA, 27 nt, Artificial Sequence
  Synthetic oligonucleotide
cuucaccaacaggaacuaugaccucga

SEQ ID NO: 2118 - RNA, 27 nt, Artificial Sequence
  Synthetic oligonucleotide
uucaccaacaggaacuaugaccucgac

SEQ ID NO: 2119 - RNA, 27 nt, Artificial Sequence
  Synthetic oligonucleotide
ucaccaacaggaacuaugaccucgacu

SEQ ID NO: 2120 - RNA, 27 nt, Artificial Sequence
  Synthetic oligonucleotide
caccaacaggaacuaugaccucgacua

SEQ ID NO: 2121 - RNA, 27 nt, Artificial Sequence
  Synthetic oligonucleotide
accaacaggaacuaugaccucgacuac

SEQ ID NO: 2122 - RNA, 27 nt, Artificial Sequence
  Synthetic oligonucleotide
ccaacaggaacuaugaccucgacuacg

SEQ ID NO: 2123 - RNA, 27 nt, Artificial Sequence
  Synthetic oligonucleotide
caacaggaacuaugaccucgacuacga

SEQ ID NO: 2124 - RNA, 27 nt, Artificial Sequence
  Synthetic oligonucleotide
aacaggaacuaugaccucgacuacgac

SEQ ID NO: 2125 - RNA, 27 nt, Artificial Sequence
  Synthetic oligonucleotide
acaggaacuaugaccucgacuacgacu

SEQ ID NO: 2126 - RNA, 27 nt, Artificial Sequence
  Synthetic oligonucleotide
caggaacuaugaccucgacuacgacuc

SEQ ID NO: 2127 - RNA, 27 nt, Artificial Sequence
  Synthetic oligonucleotide
aggaacuaugaccucgacuacgacucg

SEQ ID NO: 2128 - RNA, 27 nt, Artificial Sequence
  Synthetic oligonucleotide
ggaacuaugaccucgacuacgacucgg

SEQ ID NO: 2129 - RNA, 27 nt, Artificial Sequence
  Synthetic oligonucleotide
gaacuaugaccucgacuacgacucggu

SEQ ID NO: 2130 - RNA, 27 nt, Artificial Sequence
  Synthetic oligonucleotide
aacuaugaccucgacuacgacucggug

SEQ ID NO: 2131 - RNA, 27 nt, Artificial Sequence
  Synthetic oligonucleotide
acuaugaccucgacuacgacucggugc

SEQ ID NO: 2132 - RNA, 27 nt, Artificial Sequence
  Synthetic oligonucleotide
cuaugaccucgacuacgacucggugca

SEQ ID NO: 2133 - RNA, 27 nt, Artificial Sequence
  Synthetic oligonucleotide
gcgaggauaucuggaagaaauucgagc

SEQ ID NO: 2134 - RNA, 27 nt, Artificial Sequence
  Synthetic oligonucleotide
cgaggauaucuggaagaaauucgagcu

SEQ ID NO: 2135 - RNA, 27 nt, Artificial Sequence
  Synthetic oligonucleotide
gaggauaucuggaagaaauucgagcug

SEQ ID NO: 2136 - RNA, 27 nt, Artificial Sequence
  Synthetic oligonucleotide
aggauaucuggaagaaauucgagcugc

SEQ ID NO: 2137 - RNA, 27 nt, Artificial Sequence
  Synthetic oligonucleotide
ggauaucuggaagaaauucgagcugcu

SEQ ID NO: 2138 - RNA, 27 nt, Artificial Sequence
  Synthetic oligonucleotide
gauaucuggaagaaauucgagcugcug

SEQ ID NO: 2139 - RNA, 27 nt, Artificial Sequence
  Synthetic oligonucleotide
auaucuggaagaaauucgagcugcugc

SEQ ID NO: 2140 - RNA, 27 nt, Artificial Sequence
  Synthetic oligonucleotide
uaucuggaagaaauucgagcugcugcc

SEQ ID NO: 2141 - RNA, 27 nt, Artificial Sequence
  Synthetic oligonucleotide
aucuggaagaaauucgagcugcugccc

SEQ ID NO: 2142 - RNA, 27 nt, Artificial Sequence
  Synthetic oligonucleotide
ucuggaagaaauucgagcugcugccca

SEQ ID NO: 2143 - RNA, 27 nt, Artificial Sequence
  Synthetic oligonucleotide
cuggaagaaauucgagcugcugcccac

SEQ ID NO: 2144 - RNA, 27 nt, Artificial Sequence
  Synthetic oligonucleotide
cuagccgccgcuccgggcucugcucgc

SEQ ID NO: 2145 - RNA, 27 nt, Artificial Sequence
  Synthetic oligonucleotide
uagccgccgcuccgggcucugcucgcc

SEQ ID NO: 2146 - RNA, 27 nt, Artificial Sequence
  Synthetic oligonucleotide
agccgccgcuccgggcucugcucgccc

SEQ ID NO: 2147 - RNA, 27 nt, Artificial Sequence
  Synthetic oligonucleotide
gccgccgcuccgggcucugcucgcccu

SEQ ID NO: 2148 - RNA, 27 nt, Artificial Sequence
  Synthetic oligonucleotide
ccgccgcuccgggcucugcucgcccuc

SEQ ID NO: 2149 - RNA, 27 nt, Artificial Sequence
  Synthetic oligonucleotide
ugggaggagacauggugaaccagaguu

SEQ ID NO: 2150 - RNA, 27 nt, Artificial Sequence
  Synthetic oligonucleotide
gggaggagacauggugaaccagaguuu

SEQ ID NO: 2151 - RNA, 27 nt, Artificial Sequence
  Synthetic oligonucleotide
ggaggagacauggugaaccagaguuuc

SEQ ID NO: 2152 - RNA, 27 nt, Artificial Sequence
  Synthetic oligonucleotide
gaggagacauggugaaccagaguuuca

SEQ ID NO: 2153 - RNA, 27 nt, Artificial Sequence
  Synthetic oligonucleotide
aggagacauggugaaccagaguuucau

SEQ ID NO: 2154 - RNA, 27 nt, Artificial Sequence
  Synthetic oligonucleotide
cggacgacgagaccuucaucaaaaaca

SEQ ID NO: 2155 - RNA, 27 nt, Artificial Sequence
  Synthetic oligonucleotide
ggacgacgagaccuucaucaaaaacau

SEQ ID NO: 2156 - RNA, 27 nt, Artificial Sequence
  Synthetic oligonucleotide
aaaacaucaucauccaggacuguaugu

SEQ ID NO: 2157 - RNA, 27 nt, Artificial Sequence
  Synthetic oligonucleotide
aaacaucaucauccaggacuguaugug

SEQ ID NO: 2158 - RNA, 27 nt, Artificial Sequence
  Synthetic oligonucleotide
aacaucaucauccaggacuguaugugg

SEQ ID NO: 2159 - RNA, 27 nt, Artificial Sequence
  Synthetic oligonucleotide
acaucaucauccaggacuguaugugga

SEQ ID NO: 2160 - RNA, 27 nt, Artificial Sequence
  Synthetic oligonucleotide
caucaucauccaggacuguauguggag

SEQ ID NO: 2161 - RNA, 27 nt, Artificial Sequence
  Synthetic oligonucleotide
aucaucauccaggacuguauguggagc

SEQ ID NO: 2162 - RNA, 27 nt, Artificial Sequence
  Synthetic oligonucleotide
ucaucauccaggacuguauguggagcg

SEQ ID NO: 2163 - RNA, 27 nt, Artificial Sequence
  Synthetic oligonucleotide
caucauccaggacuguauguggagcgg

SEQ ID NO: 2164 - RNA, 27 nt, Artificial Sequence
  Synthetic oligonucleotide
aucauccaggacuguauguggagcggc

SEQ ID NO: 2165 - RNA, 27 nt, Artificial Sequence
  Synthetic oligonucleotide
ucauccaggacuguauguggagcggcu

SEQ ID NO: 2166 - RNA, 27 nt, Artificial Sequence
  Synthetic oligonucleotide
cauccaggacuguauguggagcggcuu

SEQ ID NO: 2167 - RNA, 27 nt, Artificial Sequence
  Synthetic oligonucleotide
auccaggacuguauguggagcggcuuc

SEQ ID NO: 2168 - RNA, 27 nt, Artificial Sequence
  Synthetic oligonucleotide
uccaggacuguauguggagcggcuucu

SEQ ID NO: 2169 - RNA, 27 nt, Artificial Sequence
  Synthetic oligonucleotide
ccaggacuguauguggagcggcuucuc

SEQ ID NO: 2170 - RNA, 27 nt, Artificial Sequence
  Synthetic oligonucleotide
cagagaagcuggccuccuaccaggcug

SEQ ID NO: 2171 - RNA, 27 nt, Artificial Sequence
  Synthetic oligonucleotide
agagaagcuggccuccuaccaggcugc

SEQ ID NO: 2172 - RNA, 27 nt, Artificial Sequence
  Synthetic oligonucleotide
gagaagcuggccuccuaccaggcugcg

SEQ ID NO: 2173 - RNA, 27 nt, Artificial Sequence
  Synthetic oligonucleotide
agaagcuggccuccuaccaggcugcgc

SEQ ID NO: 2174 - RNA, 27 nt, Artificial Sequence
  Synthetic oligonucleotide
gaagcuggccuccuaccaggcugcgcg

SEQ ID NO: 2175 - RNA, 27 nt, Artificial Sequence
  Synthetic oligonucleotide
aagcuggccuccuaccaggcugcgcgc

SEQ ID NO: 2176 - RNA, 27 nt, Artificial Sequence
  Synthetic oligonucleotide
agcuggccuccuaccaggcugcgcgca

SEQ ID NO: 2177 - RNA, 27 nt, Artificial Sequence
  Synthetic oligonucleotide
gcuggccuccuaccaggcugcgcgcaa

SEQ ID NO: 2178 - RNA, 27 nt, Artificial Sequence
  Synthetic oligonucleotide
cuggccuccuaccaggcugcgcgcaaa

SEQ ID NO: 2179 - RNA, 27 nt, Artificial Sequence
  Synthetic oligonucleotide
uggccuccuaccaggcugcgcgcaaag

SEQ ID NO: 2180 - RNA, 27 nt, Artificial Sequence
  Synthetic oligonucleotide
ggccuccuaccaggcugcgcgcaaaga

SEQ ID NO: 2181 - RNA, 27 nt, Artificial Sequence
  Synthetic oligonucleotide
gccuccuaccaggcugcgcgcaaagac

SEQ ID NO: 2182 - RNA, 27 nt, Artificial Sequence
  Synthetic oligonucleotide
ccuccuaccaggcugcgcgcaaagaca

SEQ ID NO: 2183 - RNA, 27 nt, Artificial Sequence
  Synthetic oligonucleotide
cuccuaccaggcugcgcgcaaagacag

SEQ ID NO: 2184 - RNA, 27 nt, Artificial Sequence
  Synthetic oligonucleotide
uccuaccaggcugcgcgcaaagacagc

SEQ ID NO: 2185 - RNA, 27 nt, Artificial Sequence
  Synthetic oligonucleotide
ccuaccaggcugcgcgcaaagacagcg

SEQ ID NO: 2186 - RNA, 27 nt, Artificial Sequence
  Synthetic oligonucleotide
cuaccaggcugcgcgcaaagacagcgg

SEQ ID NO: 2187 - RNA, 27 nt, Artificial Sequence
  Synthetic oligonucleotide
uaccaggcugcgcgcaaagacagcggc

SEQ ID NO: 2188 - RNA, 27 nt, Artificial Sequence
  Synthetic oligonucleotide
accaggcugcgcgcaaagacagcggca

SEQ ID NO: 2189 - RNA, 27 nt, Artificial Sequence
  Synthetic oligonucleotide
ccaggcugcgcgcaaagacagcggcag

SEQ ID NO: 2190 - RNA, 27 nt, Artificial Sequence
  Synthetic oligonucleotide
caggcugcgcgcaaagacagcggcagc

SEQ ID NO: 2191 - RNA, 27 nt, Artificial Sequence
  Synthetic oligonucleotide
gccacagcgucugcuccaccuccagcu

SEQ ID NO: 2192 - RNA, 27 nt, Artificial Sequence
  Synthetic oligonucleotide
ccacagcgucugcuccaccuccagcuu

SEQ ID NO: 2193 - RNA, 27 nt, Artificial Sequence
  Synthetic oligonucleotide
cacagcgucugcuccaccuccagcuug

SEQ ID NO: 2194 - RNA, 27 nt, Artificial Sequence
  Synthetic oligonucleotide
acagcgucugcuccaccuccagcuugu

SEQ ID NO: 2195 - RNA, 27 nt, Artificial Sequence
  Synthetic oligonucleotide
cagcgucugcuccaccuccagcuugua

SEQ ID NO: 2196 - RNA, 27 nt, Artificial Sequence
  Synthetic oligonucleotide
agcgucugcuccaccuccagcuuguac

SEQ ID NO: 2197 - RNA, 27 nt, Artificial Sequence
  Synthetic oligonucleotide
cucucaacgacagcagcucgcccaagu

SEQ ID NO: 2198 - RNA, 27 nt, Artificial Sequence
  Synthetic oligonucleotide
ucucaacgacagcagcucgcccaaguc

SEQ ID NO: 2199 - RNA, 27 nt, Artificial Sequence
  Synthetic oligonucleotide
cucaacgacagcagcucgcccaagucc

SEQ ID NO: 2200 - RNA, 27 nt, Artificial Sequence
  Synthetic oligonucleotide
ucaacgacagcagcucgcccaaguccu

SEQ ID NO: 2201 - RNA, 27 nt, Artificial Sequence
  Synthetic oligonucleotide
caacgacagcagcucgcccaaguccug

SEQ ID NO: 2202 - RNA, 27 nt, Artificial Sequence
  Synthetic oligonucleotide
uccaugaggagacaccgcccaccacca

SEQ ID NO: 2203 - RNA, 27 nt, Artificial Sequence
  Synthetic oligonucleotide
ccaugaggagacaccgcccaccaccag

SEQ ID NO: 2204 - RNA, 27 nt, Artificial Sequence
  Synthetic oligonucleotide
caugaggagacaccgcccaccaccagc

SEQ ID NO: 2205 - RNA, 27 nt, Artificial Sequence
  Synthetic oligonucleotide
augaggagacaccgcccaccaccagca

SEQ ID NO: 2206 - RNA, 27 nt, Artificial Sequence
  Synthetic oligonucleotide
ugaggagacaccgcccaccaccagcag

SEQ ID NO: 2207 - RNA, 27 nt, Artificial Sequence
  Synthetic oligonucleotide
gaggagacaccgcccaccaccagcagc

SEQ ID NO: 2208 - RNA, 27 nt, Artificial Sequence
  Synthetic oligonucleotide
aggagacaccgcccaccaccagcagcg

SEQ ID NO: 2209 - RNA, 27 nt, Artificial Sequence
  Synthetic oligonucleotide
ggagacaccgcccaccaccagcagcga

SEQ ID NO: 2210 - RNA, 27 nt, Artificial Sequence
  Synthetic oligonucleotide
gagacaccgcccaccaccagcagcgac

SEQ ID NO: 2211 - RNA, 27 nt, Artificial Sequence
  Synthetic oligonucleotide
agacaccgcccaccaccagcagcgacu

SEQ ID NO: 2212 - RNA, 27 nt, Artificial Sequence
  Synthetic oligonucleotide
gacaccgcccaccaccagcagcgacuc

SEQ ID NO: 2213 - RNA, 27 nt, Artificial Sequence
  Synthetic oligonucleotide
acaccgcccaccaccagcagcgacucu

SEQ ID NO: 2214 - RNA, 27 nt, Artificial Sequence
  Synthetic oligonucleotide
caccgcccaccaccagcagcgacucug

SEQ ID NO: 2215 - RNA, 27 nt, Artificial Sequence
  Synthetic oligonucleotide
accgcccaccaccagcagcgacucuga

SEQ ID NO: 2216 - RNA, 27 nt, Artificial Sequence
  Synthetic oligonucleotide
ccgcccaccaccagcagcgacucugag

SEQ ID NO: 2217 - RNA, 27 nt, Artificial Sequence
  Synthetic oligonucleotide
cgcccaccaccagcagcgacucugagg

SEQ ID NO: 2218 - RNA, 27 nt, Artificial Sequence
  Synthetic oligonucleotide
gcccaccaccagcagcgacucugagga

SEQ ID NO: 2219 - RNA, 27 nt, Artificial Sequence
  Synthetic oligonucleotide
cccaccaccagcagcgacucugaggag

SEQ ID NO: 2220 - RNA, 27 nt, Artificial Sequence
  Synthetic oligonucleotide
ccaccaccagcagcgacucugaggagg

SEQ ID NO: 2221 - RNA, 27 nt, Artificial Sequence
  Synthetic oligonucleotide
caccaccagcagcgacucugaggagga

SEQ ID NO: 2222 - RNA, 27 nt, Artificial Sequence
  Synthetic oligonucleotide
aacaagaagaugaggaagaaaucgaug

SEQ ID NO: 2223 - RNA, 27 nt, Artificial Sequence
  Synthetic oligonucleotide
acaagaagaugaggaagaaaucgaugu

SEQ ID NO: 2224 - RNA, 27 nt, Artificial Sequence
  Synthetic oligonucleotide
uggaggccacagcaaaccuccucacag

SEQ ID NO: 2225 - RNA, 27 nt, Artificial Sequence
  Synthetic oligonucleotide
cucacagcccacugguccucaagaggu

SEQ ID NO: 2226 - RNA, 27 nt, Artificial Sequence
  Synthetic oligonucleotide
ucacagcccacugguccucaagaggug

SEQ ID NO: 2227 - RNA, 27 nt, Artificial Sequence
  Synthetic oligonucleotide
cacagcccacugguccucaagaggugc

SEQ ID NO: 2228 - RNA, 27 nt, Artificial Sequence
  Synthetic oligonucleotide
acagcccacugguccucaagaggugcc

SEQ ID NO: 2229 - RNA, 27 nt, Artificial Sequence
  Synthetic oligonucleotide
cagcccacugguccucaagaggugcca

SEQ ID NO: 2230 - RNA, 27 nt, Artificial Sequence
  Synthetic oligonucleotide
agcccacugguccucaagaggugccac

SEQ ID NO: 2231 - RNA, 27 nt, Artificial Sequence
  Synthetic oligonucleotide
gcccacugguccucaagaggugccacg

SEQ ID NO: 2232 - RNA, 27 nt, Artificial Sequence
  Synthetic oligonucleotide
cccacugguccucaagaggugccacgu

SEQ ID NO: 2233 - RNA, 27 nt, Artificial Sequence
  Synthetic oligonucleotide
ccacugguccucaagaggugccacguc

SEQ ID NO: 2234 - RNA, 27 nt, Artificial Sequence
  Synthetic oligonucleotide
cacugguccucaagaggugccacgucu

SEQ ID NO: 2235 - RNA, 27 nt, Artificial Sequence
  Synthetic oligonucleotide
acugguccucaagaggugccacgucuc

SEQ ID NO: 2236 - RNA, 27 nt, Artificial Sequence
  Synthetic oligonucleotide
cugguccucaagaggugccacgucucc

SEQ ID NO: 2237 - RNA, 27 nt, Artificial Sequence
  Synthetic oligonucleotide
ugguccucaagaggugccacgucucca

SEQ ID NO: 2238 - RNA, 27 nt, Artificial Sequence
  Synthetic oligonucleotide
gguccucaagaggugccacgucuccac

SEQ ID NO: 2239 - RNA, 27 nt, Artificial Sequence
  Synthetic oligonucleotide
guccucaagaggugccacgucuccaca

SEQ ID NO: 2240 - RNA, 27 nt, Artificial Sequence
  Synthetic oligonucleotide
uccucaagaggugccacgucuccacac

SEQ ID NO: 2241 - RNA, 27 nt, Artificial Sequence
  Synthetic oligonucleotide
ggagcuuuuuugcccugcgugaccaga

SEQ ID NO: 2242 - RNA, 27 nt, Artificial Sequence
  Synthetic oligonucleotide
gagcuuuuuugcccugcgugaccagau

SEQ ID NO: 2243 - RNA, 27 nt, Artificial Sequence
  Synthetic oligonucleotide
agcuuuuuugcccugcgugaccagauc

SEQ ID NO: 2244 - RNA, 27 nt, Artificial Sequence
  Synthetic oligonucleotide
gcuuuuuugcccugcgugaccagaucc

SEQ ID NO: 2245 - RNA, 27 nt, Artificial Sequence
  Synthetic oligonucleotide
cuuuuuugcccugcgugaccagauccc

SEQ ID NO: 2246 - RNA, 27 nt, Artificial Sequence
  Synthetic oligonucleotide
uuuuuugcccugcgugaccagaucccg

SEQ ID NO: 2247 - RNA, 27 nt, Artificial Sequence
  Synthetic oligonucleotide
uuuuugcccugcgugaccagaucccgg

SEQ ID NO: 2248 - RNA, 27 nt, Artificial Sequence
  Synthetic oligonucleotide
uuuugcccugcgugaccagaucccgga

SEQ ID NO: 2249 - RNA, 27 nt, Artificial Sequence
  Synthetic oligonucleotide
uuugcccugcgugaccagaucccggag

SEQ ID NO: 2250 - RNA, 27 nt, Artificial Sequence
  Synthetic oligonucleotide
uugcccugcgugaccagaucccggagu

SEQ ID NO: 2251 - RNA, 27 nt, Artificial Sequence
  Synthetic oligonucleotide
ugcccugcgugaccagaucccggaguu

SEQ ID NO: 2252 - RNA, 27 nt, Artificial Sequence
  Synthetic oligonucleotide
gcggaaacgacgagaacaguugaaaca

SEQ ID NO: 2253 - RNA, 27 nt, Artificial Sequence
  Synthetic oligonucleotide
cggaaacgacgagaacaguugaaacac

SEQ ID NO: 2254 - RNA, 27 nt, Artificial Sequence
  Synthetic oligonucleotide
ucuuuaacagauuuguauuuaagaauu

SEQ ID NO: 2255 - RNA, 27 nt, Artificial Sequence
  Synthetic oligonucleotide
cuuuaacagauuuguauuuaagaauug

SEQ ID NO: 2256 - RNA, 27 nt, Artificial Sequence
  Synthetic oligonucleotide
uuaaauguaaauaacuuuaauaaaacg

SEQ ID NO: 2257 - RNA, 27 nt, Artificial Sequence
  Synthetic oligonucleotide
uaaauguaaauaacuuuaauaaaacgu

SEQ ID NO: 2258 - RNA, 27 nt, Artificial Sequence
  Synthetic oligonucleotide
aaauguaaauaacuuuaauaaaacguu

SEQ ID NO: 2259 - RNA, 27 nt, Artificial Sequence
  Synthetic oligonucleotide
aauguaaauaacuuuaauaaaacguuu

SEQ ID NO: 2260 - RNA, 27 nt, Artificial Sequence
  Synthetic oligonucleotide
auguaaauaacuuuaauaaaacguuua

SEQ ID NO: 2261 - RNA, 27 nt, Artificial Sequence
  Synthetic oligonucleotide
uguaaauaacuuuaauaaaacguuuau

SEQ ID NO: 2262 - RNA, 27 nt, Artificial Sequence
  Synthetic oligonucleotide
guaaauaacuuuaauaaaacguuuaua

SEQ ID NO: 2263 - RNA, 27 nt, Artificial Sequence
  Synthetic oligonucleotide
uaaauaacuuuaauaaaacguuuauag

SEQ ID NO: 2264 - RNA, 27 nt, Artificial Sequence
  Synthetic oligonucleotide
aaauaacuuuaauaaaacguuuauagc

SEQ ID NO: 2265 - RNA, 27 nt, Artificial Sequence
  Synthetic oligonucleotide
aauaacuuuaauaaaacguuuauagca

SEQ ID NO: 2266 - RNA, 27 nt, Artificial Sequence
  Synthetic oligonucleotide
auaacuuuaauaaaacguuuauagcag

SEQ ID NO: 2267 - RNA, 27 nt, Artificial Sequence
  Synthetic oligonucleotide
uaacuuuaauaaaacguuuauagcagu

SEQ ID NO: 2268 - RNA, 27 nt, Artificial Sequence
  Synthetic oligonucleotide
aacuuuaauaaaacguuuauagcaguu

SEQ ID NO: 2269 - RNA, 27 nt, Artificial Sequence
  Synthetic oligonucleotide
gcuuuuuaaaguugauuuuuuucuauu

SEQ ID NO: 2270 - RNA, 27 nt, Artificial Sequence
  Synthetic oligonucleotide
cuuuuuaaaguugauuuuuuucuauug

SEQ ID NO: 2271 - RNA, 27 nt, Artificial Sequence
  Synthetic oligonucleotide
uuuuuaaaguugauuuuuuucuauugu

SEQ ID NO: 2272 - RNA, 27 nt, Artificial Sequence
  Synthetic oligonucleotide
uuuuaaaguugauuuuuuucuauuguu

SEQ ID NO: 2273 - RNA, 27 nt, Artificial Sequence
  Synthetic oligonucleotide
uuuaaaguugauuuuuuucuauuguuu

SEQ ID NO: 2274 - RNA, 27 nt, Artificial Sequence
  Synthetic oligonucleotide
uuaaaguugauuuuuuucuauuguuuu

SEQ ID NO: 2275 - RNA, 27 nt, Artificial Sequence
  Synthetic oligonucleotide
uaaaguugauuuuuuucuauuguuuuu

SEQ ID NO: 2276 - RNA, 27 nt, Artificial Sequence
  Synthetic oligonucleotide
aaaguugauuuuuuucuauuguuuuua

SEQ ID NO: 2277 - RNA, 27 nt, Artificial Sequence
  Synthetic oligonucleotide
aaguugauuuuuuucuauuguuuuuag

SEQ ID NO: 2278 - RNA, 27 nt, Artificial Sequence
  Synthetic oligonucleotide
aguugauuuuuuucuauuguuuuuaga

SEQ ID NO: 2279 - RNA, 27 nt, Artificial Sequence
  Synthetic oligonucleotide
guugauuuuuuucuauuguuuuuagaa

SEQ ID NO: 2280 - RNA, 27 nt, Artificial Sequence
  Synthetic oligonucleotide
uugauuuuuuucuauuguuuuuagaaa

SEQ ID NO: 2281 - RNA, 27 nt, Artificial Sequence
  Synthetic oligonucleotide
ugauuuuuuucuauuguuuuuagaaaa

SEQ ID NO: 2282 - RNA, 27 nt, Artificial Sequence
  Synthetic oligonucleotide
gauuuuuuucuauuguuuuuagaaaaa

SEQ ID NO: 2283 - RNA, 27 nt, Artificial Sequence
  Synthetic oligonucleotide
auuuuuuucuauuguuuuuagaaaaaa

SEQ ID NO: 2284 - RNA, 27 nt, Artificial Sequence
  Synthetic oligonucleotide
uuuuuuucuauuguuuuuagaaaaaau

SEQ ID NO: 2285 - RNA, 27 nt, Artificial Sequence
  Synthetic oligonucleotide
uuuuuucuauuguuuuuagaaaaaaua

SEQ ID NO: 2286 - RNA, 27 nt, Artificial Sequence
  Synthetic oligonucleotide
uuuuucuauuguuuuuagaaaaaauaa

SEQ ID NO: 2287 - RNA, 27 nt, Artificial Sequence
  Synthetic oligonucleotide
uuuucuauuguuuuuagaaaaaauaaa

SEQ ID NO: 2288 - RNA, 27 nt, Artificial Sequence
  Synthetic oligonucleotide
uuucuauuguuuuuagaaaaaauaaaa

SEQ ID NO: 2289 - RNA, 27 nt, Artificial Sequence
  Synthetic oligonucleotide
uucuauuguuuuuagaaaaaauaaaau

SEQ ID NO: 2290 - RNA, 19 nt, Artificial Sequence
  Synthetic oligonucleotide
cgagaagggcagggcuucu

SEQ ID NO: 2291 - RNA, 19 nt, Artificial Sequence
  Synthetic oligonucleotide
gcuuuaucuaacucgcugu

SEQ ID NO: 2292 - RNA, 19 nt, Artificial Sequence
  Synthetic oligonucleotide
cccuugccgcauccacgaa

SEQ ID NO: 2293 - RNA, 19 nt, Artificial Sequence
  Synthetic oligonucleotide
gccgcauccacgaaacuuu

SEQ ID NO: 2294 - RNA, 19 nt, Artificial Sequence
  Synthetic oligonucleotide
uccacgaaacuuugcccau

SEQ ID NO: 2295 - RNA, 19 nt, Artificial Sequence
  Synthetic oligonucleotide
gcgggcacuuugcacugga

SEQ ID NO: 2296 - RNA, 19 nt, Artificial Sequence
  Synthetic oligonucleotide
acuuugcacuggaacuuac

SEQ ID NO: 2297 - RNA, 19 nt, Artificial Sequence
  Synthetic oligonucleotide
cuggaacuuacaacacccg

SEQ ID NO: 2298 - RNA, 19 nt, Artificial Sequence
  Synthetic oligonucleotide
gcagcugcuuagacgcugg

SEQ ID NO: 2299 - RNA, 19 nt, Artificial Sequence
  Synthetic oligonucleotide
gcuuagacgcuggauuuuu

SEQ ID NO: 2300 - RNA, 19 nt, Artificial Sequence
  Synthetic oligonucleotide
cgcuggauuuuuuucgggu

SEQ ID NO: 2301 - RNA, 19 nt, Artificial Sequence
  Synthetic oligonucleotide
gauuuuuuucggguagugg

SEQ ID NO: 2302 - RNA, 19 nt, Artificial Sequence
  Synthetic oligonucleotide
cggguaguggaaaaccagc

SEQ ID NO: 2303 - RNA, 19 nt, Artificial Sequence
  Synthetic oligonucleotide
cucaacguuagcuucacca

SEQ ID NO: 2304 - RNA, 19 nt, Artificial Sequence
  Synthetic oligonucleotide
guuagcuucaccaacagga

SEQ ID NO: 2305 - RNA, 19 nt, Artificial Sequence
  Synthetic oligonucleotide
gacucggugcagccguauu

SEQ ID NO: 2306 - RNA, 19 nt, Artificial Sequence
  Synthetic oligonucleotide
gcagccguauuucuacugc

SEQ ID NO: 2307 - RNA, 19 nt, Artificial Sequence
  Synthetic oligonucleotide
gaggagaacuucuaccagc

SEQ ID NO: 2308 - RNA, 19 nt, Artificial Sequence
  Synthetic oligonucleotide
gcgaggauaucuggaagaa

SEQ ID NO: 2309 - RNA, 19 nt, Artificial Sequence
  Synthetic oligonucleotide
cguugcggucacacccuuc

SEQ ID NO: 2310 - RNA, 19 nt, Artificial Sequence
  Synthetic oligonucleotide
acauggugaaccagaguuu

SEQ ID NO: 2311 - RNA, 19 nt, Artificial Sequence
  Synthetic oligonucleotide
ccggacgacgagaccuuca

SEQ ID NO: 2312 - RNA, 19 nt, Artificial Sequence
  Synthetic oligonucleotide
gagaccuucaucaaaaaca

SEQ ID NO: 2313 - RNA, 19 nt, Artificial Sequence
  Synthetic oligonucleotide
aaaaacaucaucauccagg

SEQ ID NO: 2314 - RNA, 19 nt, Artificial Sequence
  Synthetic oligonucleotide
ggacuguauguggagcggc

SEQ ID NO: 2315 - RNA, 19 nt, Artificial Sequence
  Synthetic oligonucleotide
cugcuccaccuccagcuug

SEQ ID NO: 2316 - RNA, 19 nt, Artificial Sequence
  Synthetic oligonucleotide
accuccagcuuguaccugc

SEQ ID NO: 2317 - RNA, 19 nt, Artificial Sequence
  Synthetic oligonucleotide
cagcuuguaccugcaggau

SEQ ID NO: 2318 - RNA, 19 nt, Artificial Sequence
  Synthetic oligonucleotide
aaguccugcgccucgcaag

SEQ ID NO: 2319 - RNA, 19 nt, Artificial Sequence
  Synthetic oligonucleotide
gcagcgacucugaggagga

SEQ ID NO: 2320 - RNA, 19 nt, Artificial Sequence
  Synthetic oligonucleotide
acucugaggaggaacaaga

SEQ ID NO: 2321 - RNA, 19 nt, Artificial Sequence
  Synthetic oligonucleotide
gaggaggaacaagaagaug

SEQ ID NO: 2322 - RNA, 19 nt, Artificial Sequence
  Synthetic oligonucleotide
aacaagaagaugaggaaga

SEQ ID NO: 2323 - RNA, 19 nt, Artificial Sequence
  Synthetic oligonucleotide
aagaugaggaagaaaucga

SEQ ID NO: 2324 - RNA, 19 nt, Artificial Sequence
  Synthetic oligonucleotide
aggaagaaaucgauguugu

SEQ ID NO: 2325 - RNA, 19 nt, Artificial Sequence
  Synthetic oligonucleotide
aaaucgauguuguuucugu

SEQ ID NO: 2326 - RNA, 19 nt, Artificial Sequence
  Synthetic oligonucleotide
auguuguuucuguggaaaa

SEQ ID NO: 2327 - RNA, 19 nt, Artificial Sequence
  Synthetic oligonucleotide
gaggcaggcuccuggcaaa

SEQ ID NO: 2328 - RNA, 19 nt, Artificial Sequence
  Synthetic oligonucleotide
aggcuccuggcaaaagguc

SEQ ID NO: 2329 - RNA, 19 nt, Artificial Sequence
  Synthetic oligonucleotide
ccuggcaaaaggucagagu

SEQ ID NO: 2330 - RNA, 19 nt, Artificial Sequence
  Synthetic oligonucleotide
caaaaggucagagucugga

SEQ ID NO: 2331 - RNA, 19 nt, Artificial Sequence
  Synthetic oligonucleotide
ggucagagucuggaucacc

SEQ ID NO: 2332 - RNA, 19 nt, Artificial Sequence
  Synthetic oligonucleotide
gcaaaccuccucacagccc

SEQ ID NO: 2333 - RNA, 19 nt, Artificial Sequence
  Synthetic oligonucleotide
ccucacagcccacuggucc

SEQ ID NO: 2334 - RNA, 19 nt, Artificial Sequence
  Synthetic oligonucleotide
cccuccacucggaaggacu

SEQ ID NO: 2335 - RNA, 19 nt, Artificial Sequence
  Synthetic oligonucleotide
cucggaaggacuauccugc

SEQ ID NO: 2336 - RNA, 19 nt, Artificial Sequence
  Synthetic oligonucleotide
auccugcugccaagagggu

SEQ ID NO: 2337 - RNA, 19 nt, Artificial Sequence
  Synthetic oligonucleotide
gcugccaagagggucaagu

SEQ ID NO: 2338 - RNA, 19 nt, Artificial Sequence
  Synthetic oligonucleotide
caagagggucaaguuggac

SEQ ID NO: 2339 - RNA, 19 nt, Artificial Sequence
  Synthetic oligonucleotide
gggucaaguuggacagugu

SEQ ID NO: 2340 - RNA, 19 nt, Artificial Sequence
  Synthetic oligonucleotide
aaguuggacagugucagag

SEQ ID NO: 2341 - RNA, 19 nt, Artificial Sequence
  Synthetic oligonucleotide
ggacagugucagaguccug

SEQ ID NO: 2342 - RNA, 19 nt, Artificial Sequence
  Synthetic oligonucleotide
cagaguccugagacagauc

SEQ ID NO: 2343 - RNA, 19 nt, Artificial Sequence
  Synthetic oligonucleotide
gagacagaucagcaacaac

SEQ ID NO: 2344 - RNA, 19 nt, Artificial Sequence
  Synthetic oligonucleotide
gaucagcaacaaccgaaaa

SEQ ID NO: 2345 - RNA, 19 nt, Artificial Sequence
  Synthetic oligonucleotide
ccucggacaccgaggagaa

SEQ ID NO: 2346 - RNA, 19 nt, Artificial Sequence
  Synthetic oligonucleotide
gacaccgaggagaauguca

SEQ ID NO: 2347 - RNA, 19 nt, Artificial Sequence
  Synthetic oligonucleotide
cagaggaggaacgagcuaa

SEQ ID NO: 2348 - RNA, 19 nt, Artificial Sequence
  Synthetic oligonucleotide
aggaacgagcuaaaacgga

SEQ ID NO: 2349 - RNA, 19 nt, Artificial Sequence
  Synthetic oligonucleotide
cgagcuaaaacggagcuuu

SEQ ID NO: 2350 - RNA, 19 nt, Artificial Sequence
  Synthetic oligonucleotide
aaaacggagcuuuuuugcc

SEQ ID NO: 2351 - RNA, 19 nt, Artificial Sequence
  Synthetic oligonucleotide
ggagcuuuuuugcccugcg

SEQ ID NO: 2352 - RNA, 19 nt, Artificial Sequence
  Synthetic oligonucleotide
gaccagaucccggaguugg

SEQ ID NO: 2353 - RNA, 19 nt, Artificial Sequence
  Synthetic oligonucleotide
gaucccggaguuggaaaac

SEQ ID NO: 2354 - RNA, 19 nt, Artificial Sequence
  Synthetic oligonucleotide
cggaguuggaaaacaauga

SEQ ID NO: 2355 - RNA, 19 nt, Artificial Sequence
  Synthetic oligonucleotide
agguaguuauccuuaaaaa

SEQ ID NO: 2356 - RNA, 19 nt, Artificial Sequence
  Synthetic oligonucleotide
guuauccuuaaaaaagcca

SEQ ID NO: 2357 - RNA, 19 nt, Artificial Sequence
  Synthetic oligonucleotide
ccuuaaaaaagccacagca

SEQ ID NO: 2358 - RNA, 19 nt, Artificial Sequence
  Synthetic oligonucleotide
aaaaagccacagcauacau

SEQ ID NO: 2359 - RNA, 19 nt, Artificial Sequence
  Synthetic oligonucleotide
gccacagcauacauccugu

SEQ ID NO: 2360 - RNA, 19 nt, Artificial Sequence
  Synthetic oligonucleotide
gcauacauccuguccgucc

SEQ ID NO: 2361 - RNA, 19 nt, Artificial Sequence
  Synthetic oligonucleotide
ccuguccguccaagcagag

SEQ ID NO: 2362 - RNA, 19 nt, Artificial Sequence
  Synthetic oligonucleotide
ccguccaagcagaggagca

SEQ ID NO: 2363 - RNA, 19 nt, Artificial Sequence
  Synthetic oligonucleotide
gcagaggagcaaaagcuca

SEQ ID NO: 2364 - RNA, 19 nt, Artificial Sequence
  Synthetic oligonucleotide
agcaaaagcucauuucuga

SEQ ID NO: 2365 - RNA, 19 nt, Artificial Sequence
  Synthetic oligonucleotide
aagcucauuucugaagagg

SEQ ID NO: 2366 - RNA, 19 nt, Artificial Sequence
  Synthetic oligonucleotide
auuucugaagaggacuugu

SEQ ID NO: 2367 - RNA, 19 nt, Artificial Sequence
  Synthetic oligonucleotide
gaagaggacuuguugcgga

SEQ ID NO: 2368 - RNA, 19 nt, Artificial Sequence
  Synthetic oligonucleotide
ggacuuguugcggaaacga

SEQ ID NO: 2369 - RNA, 19 nt, Artificial Sequence
  Synthetic oligonucleotide
uguugcggaaacgacgaga

SEQ ID NO: 2370 - RNA, 19 nt, Artificial Sequence
  Synthetic oligonucleotide
cggaaacgacgagaacagu

SEQ ID NO: 2371 - RNA, 19 nt, Artificial Sequence
  Synthetic oligonucleotide
aaacuugaacagcuacgga

SEQ ID NO: 2372 - RNA, 19 nt, Artificial Sequence
  Synthetic oligonucleotide
gaacagcuacggaacucuu

SEQ ID NO: 2373 - RNA, 19 nt, Artificial Sequence
  Synthetic oligonucleotide
gcuacggaacucuugugcg

SEQ ID NO: 2374 - RNA, 19 nt, Artificial Sequence
  Synthetic oligonucleotide
aacucuugugcguaaggaa

SEQ ID NO: 2375 - RNA, 19 nt, Artificial Sequence
  Synthetic oligonucleotide
ugugcguaaggaaaaguaa

SEQ ID NO: 2376 - RNA, 19 nt, Artificial Sequence
  Synthetic oligonucleotide
guaaggaaaaguaaggaaa

SEQ ID NO: 2377 - RNA, 19 nt, Artificial Sequence
  Synthetic oligonucleotide
guaaggaaaacgauuccuu

SEQ ID NO: 2378 - RNA, 19 nt, Artificial Sequence
  Synthetic oligonucleotide
gaaaacgauuccuucuaac

SEQ ID NO: 2379 - RNA, 19 nt, Artificial Sequence
  Synthetic oligonucleotide
cgauuccuucuaacagaaa

SEQ ID NO: 2380 - RNA, 19 nt, Artificial Sequence
  Synthetic oligonucleotide
cuucuaacagaaauguccu

SEQ ID NO: 2381 - RNA, 19 nt, Artificial Sequence
  Synthetic oligonucleotide
cagaaauguccugagcaau

SEQ ID NO: 2382 - RNA, 19 nt, Artificial Sequence
  Synthetic oligonucleotide
ccugagcaaucaccuauga

SEQ ID NO: 2383 - RNA, 19 nt, Artificial Sequence
  Synthetic oligonucleotide
caaucaccuaugaacuugu

SEQ ID NO: 2384 - RNA, 19 nt, Artificial Sequence
  Synthetic oligonucleotide
ccuaugaacuuguuucaaa

SEQ ID NO: 2385 - RNA, 19 nt, Artificial Sequence
  Synthetic oligonucleotide
gaacuuguuucaaaugcau

SEQ ID NO: 2386 - RNA, 19 nt, Artificial Sequence
  Synthetic oligonucleotide
guuucaaaugcaugaucaa

SEQ ID NO: 2387 - RNA, 19 nt, Artificial Sequence
  Synthetic oligonucleotide
aaaugcaugaucaaaugca

SEQ ID NO: 2388 - RNA, 19 nt, Artificial Sequence
  Synthetic oligonucleotide
gaucaaaugcaaccucaca

SEQ ID NO: 2389 - RNA, 19 nt, Artificial Sequence
  Synthetic oligonucleotide
aaugcaaccucacaaccuu

SEQ ID NO: 2390 - RNA, 19 nt, Artificial Sequence
  Synthetic oligonucleotide
ccucacaaccuuggcugag

SEQ ID NO: 2391 - RNA, 19 nt, Artificial Sequence
  Synthetic oligonucleotide
caaccuuggcugagucuug

SEQ ID NO: 2392 - RNA, 19 nt, Artificial Sequence
  Synthetic oligonucleotide
ggcugagucuugagacuga

SEQ ID NO: 2393 - RNA, 19 nt, Artificial Sequence
  Synthetic oligonucleotide
gucuugagacugaaagauu

SEQ ID NO: 2394 - RNA, 19 nt, Artificial Sequence
  Synthetic oligonucleotide
gacugaaagauuuagccau

SEQ ID NO: 2395 - RNA, 19 nt, Artificial Sequence
  Synthetic oligonucleotide
aaagauuuagccauaaugu

SEQ ID NO: 2396 - RNA, 19 nt, Artificial Sequence
  Synthetic oligonucleotide
gccauaauguaaacugccu

SEQ ID NO: 2397 - RNA, 19 nt, Artificial Sequence
  Synthetic oligonucleotide
guaaacugccucaaauugg

SEQ ID NO: 2398 - RNA, 19 nt, Artificial Sequence
  Synthetic oligonucleotide
ugccucaaauuggacuuug

SEQ ID NO: 2399 - RNA, 19 nt, Artificial Sequence
  Synthetic oligonucleotide
caaauuggacuuugggcau

SEQ ID NO: 2400 - RNA, 19 nt, Artificial Sequence
  Synthetic oligonucleotide
gacuuugggcauaaaagaa

SEQ ID NO: 2401 - RNA, 19 nt, Artificial Sequence
  Synthetic oligonucleotide
ggcauaaaagaacuuuuuu

SEQ ID NO: 2402 - RNA, 19 nt, Artificial Sequence
  Synthetic oligonucleotide
aaaagaacuuuuuuaugcu

SEQ ID NO: 2403 - RNA, 19 nt, Artificial Sequence
  Synthetic oligonucleotide
aacuuuuuuaugcuuacca

SEQ ID NO: 2404 - RNA, 19 nt, Artificial Sequence
  Synthetic oligonucleotide
uuuaugcuuaccaucuuuu

SEQ ID NO: 2405 - RNA, 19 nt, Artificial Sequence
  Synthetic oligonucleotide
gcuuaccaucuuuuuuuuu

SEQ ID NO: 2406 - RNA, 19 nt, Artificial Sequence
  Synthetic oligonucleotide
ccaucuuuuuuuuuucuuu

SEQ ID NO: 2407 - RNA, 19 nt, Artificial Sequence
  Synthetic oligonucleotide
uuuuuuuuucuuuaacaga

SEQ ID NO: 2408 - RNA, 19 nt, Artificial Sequence
  Synthetic oligonucleotide
cuuuaacagauuuguauuu

SEQ ID NO: 2409 - RNA, 19 nt, Artificial Sequence
  Synthetic oligonucleotide
cagauuuguauuuaagaau

SEQ ID NO: 2410 - RNA, 19 nt, Artificial Sequence
  Synthetic oligonucleotide
uauuuaagaauuguuuuua

SEQ ID NO: 2411 - RNA, 19 nt, Artificial Sequence
  Synthetic oligonucleotide
gaauuguuuuuaaaaaauu

SEQ ID NO: 2412 - RNA, 19 nt, Artificial Sequence
  Synthetic oligonucleotide
aauguuucucuguaaauau

SEQ ID NO: 2413 - RNA, 19 nt, Artificial Sequence
  Synthetic oligonucleotide
cuguaaauauugccauuaa

SEQ ID NO: 2414 - RNA, 19 nt, Artificial Sequence
  Synthetic oligonucleotide
aauauugccauuaaaugua

SEQ ID NO: 2415 - RNA, 19 nt, Artificial Sequence
  Synthetic oligonucleotide
ccauuaaauguaaauaacu

SEQ ID NO: 2416 - RNA, 19 nt, Artificial Sequence
  Synthetic oligonucleotide
uuaauaaaacguuuauagc

SEQ ID NO: 2417 - RNA, 19 nt, Artificial Sequence
  Synthetic oligonucleotide
cagaauuucaauccuagua

SEQ ID NO: 2418 - RNA, 19 nt, Artificial Sequence
  Synthetic oligonucleotide
cuaguauuauagguacuau

SEQ ID NO: 2419 - RNA, 19 nt, Artificial Sequence
  Synthetic oligonucleotide
uauagguacuauaaacccu

SEQ ID NO: 2420 - RNA, 19 nt, Artificial Sequence
  Synthetic oligonucleotide
acuauaaacccuaauuuuu

SEQ ID NO: 2421 - RNA, 19 nt, Artificial Sequence
  Synthetic oligonucleotide
cccuaauuuuuuuuauuua

SEQ ID NO: 2422 - RNA, 19 nt, Artificial Sequence
  Synthetic oligonucleotide
auuuuuuuuauuuaaguac

SEQ ID NO: 2423 - RNA, 19 nt, Artificial Sequence
  Synthetic oligonucleotide
uauuuaaguacauuuugcu

SEQ ID NO: 2424 - RNA, 19 nt, Artificial Sequence
  Synthetic oligonucleotide
aaguacauuuugcuuuuua

SEQ ID NO: 2425 - RNA, 19 nt, Artificial Sequence
  Synthetic oligonucleotide
auuuugcuuuuuaaaguug

SEQ ID NO: 2426 - RNA, 19 nt, Artificial Sequence
  Synthetic oligonucleotide
cuuuuuaaaguugauuuuu

SEQ ID NO: 2427 - RNA, 19 nt, Artificial Sequence
  Synthetic oligonucleotide
uauuguuuuuagaaaaaau

SEQ ID NO: 2428 - RNA, 19 nt, Artificial Sequence
  Synthetic oligonucleotide
uuuuuagaaaaaauaaaau

SEQ ID NO: 2429 - RNA, 19 nt, Artificial Sequence
  Synthetic oligonucleotide
aaaaauaaaauaacuggca

SEQ ID NO: 2430 - RNA, 19 nt, Artificial Sequence
  Synthetic oligonucleotide
aauaacuggcaaauauauc

SEQ ID NO: 2431 - RNA, 19 nt, Artificial Sequence
  Synthetic oligonucleotide
caaauauaucauugagcca

SEQ ID NO: 2432 - RNA, 19 nt, Artificial Sequence
  Synthetic oligonucleotide
aucauugagccaaaucuua

SEQ ID NO: 2433 - RNA, 19 nt, Artificial Sequence
  Synthetic oligonucleotide
gagccaaaucuuaaaaaaa

SEQ ID NO: 2434 - RNA, 19 nt, Artificial Sequence
  Synthetic oligonucleotide
acucgcuguaguaauucca

SEQ ID NO: 2435 - RNA, 19 nt, Artificial Sequence
  Synthetic oligonucleotide
cucgcuguaguaauuccag

SEQ ID NO: 2436 - RNA, 19 nt, Artificial Sequence
  Synthetic oligonucleotide
ucgcuguaguaauuccagc

SEQ ID NO: 2437 - RNA, 19 nt, Artificial Sequence
  Synthetic oligonucleotide
cgcuguaguaauuccagcg

SEQ ID NO: 2438 - RNA, 19 nt, Artificial Sequence
  Synthetic oligonucleotide
gcuguaguaauuccagcga

SEQ ID NO: 2439 - RNA, 19 nt, Artificial Sequence
  Synthetic oligonucleotide
cuguaguaauuccagcgag

SEQ ID NO: 2440 - RNA, 19 nt, Artificial Sequence
  Synthetic oligonucleotide
uguaguaauuccagcgaga

SEQ ID NO: 2441 - RNA, 19 nt, Artificial Sequence
  Synthetic oligonucleotide
guaguaauuccagcgagag

SEQ ID NO: 2442 - RNA, 19 nt, Artificial Sequence
  Synthetic oligonucleotide
cuucaccaacaggaacuau

SEQ ID NO: 2443 - RNA, 19 nt, Artificial Sequence
  Synthetic oligonucleotide
uucaccaacaggaacuaug

SEQ ID NO: 2444 - RNA, 19 nt, Artificial Sequence
  Synthetic oligonucleotide
ucaccaacaggaacuauga

SEQ ID NO: 2445 - RNA, 19 nt, Artificial Sequence
  Synthetic oligonucleotide
caccaacaggaacuaugac

SEQ ID NO: 2446 - RNA, 19 nt, Artificial Sequence
  Synthetic oligonucleotide
accaacaggaacuaugacc

SEQ ID NO: 2447 - RNA, 19 nt, Artificial Sequence
  Synthetic oligonucleotide
ccaacaggaacuaugaccu

SEQ ID NO: 2448 - RNA, 19 nt, Artificial Sequence
  Synthetic oligonucleotide
caacaggaacuaugaccuc

SEQ ID NO: 2449 - RNA, 19 nt, Artificial Sequence
  Synthetic oligonucleotide
aacaggaacuaugaccucg

SEQ ID NO: 2450 - RNA, 19 nt, Artificial Sequence
  Synthetic oligonucleotide
acaggaacuaugaccucga

SEQ ID NO: 2451 - RNA, 19 nt, Artificial Sequence
  Synthetic oligonucleotide
caggaacuaugaccucgac

SEQ ID NO: 2452 - RNA, 19 nt, Artificial Sequence
  Synthetic oligonucleotide
aggaacuaugaccucgacu

SEQ ID NO: 2453 - RNA, 19 nt, Artificial Sequence
  Synthetic oligonucleotide
ggaacuaugaccucgacua

SEQ ID NO: 2454 - RNA, 19 nt, Artificial Sequence
  Synthetic oligonucleotide
gaacuaugaccucgacuac

SEQ ID NO: 2455 - RNA, 19 nt, Artificial Sequence
  Synthetic oligonucleotide
aacuaugaccucgacuacg

SEQ ID NO: 2456 - RNA, 19 nt, Artificial Sequence
  Synthetic oligonucleotide
acuaugaccucgacuacga

SEQ ID NO: 2457 - RNA, 19 nt, Artificial Sequence
  Synthetic oligonucleotide
cuaugaccucgacuacgac

SEQ ID NO: 2458 - RNA, 19 nt, Artificial Sequence
  Synthetic oligonucleotide
uaugaccucgacuacgacu

SEQ ID NO: 2459 - RNA, 19 nt, Artificial Sequence
  Synthetic oligonucleotide
augaccucgacuacgacuc

SEQ ID NO: 2460 - RNA, 19 nt, Artificial Sequence
  Synthetic oligonucleotide
gaggauaucuggaagaaau

SEQ ID NO: 2461 - RNA, 19 nt, Artificial Sequence
  Synthetic oligonucleotide
aggauaucuggaagaaauu

SEQ ID NO: 2462 - RNA, 19 nt, Artificial Sequence
  Synthetic oligonucleotide
ggauaucuggaagaaauuc

SEQ ID NO: 2463 - RNA, 19 nt, Artificial Sequence
  Synthetic oligonucleotide
gauaucuggaagaaauucg

SEQ ID NO: 2464 - RNA, 19 nt, Artificial Sequence
  Synthetic oligonucleotide
auaucuggaagaaauucga

SEQ ID NO: 2465 - RNA, 19 nt, Artificial Sequence
  Synthetic oligonucleotide
uaucuggaagaaauucgag

SEQ ID NO: 2466 - RNA, 19 nt, Artificial Sequence
  Synthetic oligonucleotide
aucuggaagaaauucgagc

SEQ ID NO: 2467 - RNA, 19 nt, Artificial Sequence
  Synthetic oligonucleotide
ucuggaagaaauucgagcu

SEQ ID NO: 2468 - RNA, 19 nt, Artificial Sequence
  Synthetic oligonucleotide
cuggaagaaauucgagcug

SEQ ID NO: 2469 - RNA, 19 nt, Artificial Sequence
  Synthetic oligonucleotide
uggaagaaauucgagcugc

SEQ ID NO: 2470 - RNA, 19 nt, Artificial Sequence
  Synthetic oligonucleotide
ggaagaaauucgagcugcu

SEQ ID NO: 2471 - RNA, 19 nt, Artificial Sequence
  Synthetic oligonucleotide
agccgccgcuccgggcucu

SEQ ID NO: 2472 - RNA, 19 nt, Artificial Sequence
  Synthetic oligonucleotide
gccgccgcuccgggcucug

SEQ ID NO: 2473 - RNA, 19 nt, Artificial Sequence
  Synthetic oligonucleotide
ccgccgcuccgggcucugc

SEQ ID NO: 2474 - RNA, 19 nt, Artificial Sequence
  Synthetic oligonucleotide
cgccgcuccgggcucugcu

SEQ ID NO: 2475 - RNA, 19 nt, Artificial Sequence
  Synthetic oligonucleotide
gccgcuccgggcucugcuc

SEQ ID NO: 2476 - RNA, 19 nt, Artificial Sequence
  Synthetic oligonucleotide
ggaggagacauggugaacc

SEQ ID NO: 2477 - RNA, 19 nt, Artificial Sequence
  Synthetic oligonucleotide
gaggagacauggugaacca

SEQ ID NO: 2478 - RNA, 19 nt, Artificial Sequence
  Synthetic oligonucleotide
aggagacauggugaaccag

SEQ ID NO: 2479 - RNA, 19 nt, Artificial Sequence
  Synthetic oligonucleotide
ggagacauggugaaccaga

SEQ ID NO: 2480 - RNA, 19 nt, Artificial Sequence
  Synthetic oligonucleotide
gagacauggugaaccagag

SEQ ID NO: 2481 - RNA, 19 nt, Artificial Sequence
  Synthetic oligonucleotide
gacgacgagaccuucauca

SEQ ID NO: 2482 - RNA, 19 nt, Artificial Sequence
  Synthetic oligonucleotide
acgacgagaccuucaucaa

SEQ ID NO: 2483 - RNA, 19 nt, Artificial Sequence
  Synthetic oligonucleotide
aacaucaucauccaggacu

SEQ ID NO: 2484 - RNA, 19 nt, Artificial Sequence
  Synthetic oligonucleotide
acaucaucauccaggacug

SEQ ID NO: 2485 - RNA, 19 nt, Artificial Sequence
  Synthetic oligonucleotide
caucaucauccaggacugu

SEQ ID NO: 2486 - RNA, 19 nt, Artificial Sequence
  Synthetic oligonucleotide
aucaucauccaggacugua

SEQ ID NO: 2487 - RNA, 19 nt, Artificial Sequence
  Synthetic oligonucleotide
ucaucauccaggacuguau

SEQ ID NO: 2488 - RNA, 19 nt, Artificial Sequence
  Synthetic oligonucleotide
caucauccaggacuguaug

SEQ ID NO: 2489 - RNA, 19 nt, Artificial Sequence
  Synthetic oligonucleotide
aucauccaggacuguaugu

SEQ ID NO: 2490 - RNA, 19 nt, Artificial Sequence
  Synthetic oligonucleotide
ucauccaggacuguaugug

SEQ ID NO: 2491 - RNA, 19 nt, Artificial Sequence
  Synthetic oligonucleotide
cauccaggacuguaugugg

SEQ ID NO: 2492 - RNA, 19 nt, Artificial Sequence
  Synthetic oligonucleotide
auccaggacuguaugugga

SEQ ID NO: 2493 - RNA, 19 nt, Artificial Sequence
  Synthetic oligonucleotide
uccaggacuguauguggag

SEQ ID NO: 2494 - RNA, 19 nt, Artificial Sequence
  Synthetic oligonucleotide
ccaggacuguauguggagc

SEQ ID NO: 2495 - RNA, 19 nt, Artificial Sequence
  Synthetic oligonucleotide
caggacuguauguggagcg

SEQ ID NO: 2496 - RNA, 19 nt, Artificial Sequence
  Synthetic oligonucleotide
aggacuguauguggagcgg

SEQ ID NO: 2497 - RNA, 19 nt, Artificial Sequence
  Synthetic oligonucleotide
gagaagcuggccuccuacc

SEQ ID NO: 2498 - RNA, 19 nt, Artificial Sequence
  Synthetic oligonucleotide
agaagcuggccuccuacca

SEQ ID NO: 2499 - RNA, 19 nt, Artificial Sequence
  Synthetic oligonucleotide
gaagcuggccuccuaccag

SEQ ID NO: 2500 - RNA, 19 nt, Artificial Sequence
  Synthetic oligonucleotide
aagcuggccuccuaccagg

SEQ ID NO: 2501 - RNA, 19 nt, Artificial Sequence
  Synthetic oligonucleotide
agcuggccuccuaccaggc

SEQ ID NO: 2502 - RNA, 19 nt, Artificial Sequence
  Synthetic oligonucleotide
gcuggccuccuaccaggcu

SEQ ID NO: 2503 - RNA, 19 nt, Artificial Sequence
  Synthetic oligonucleotide
cuggccuccuaccaggcug

SEQ ID NO: 2504 - RNA, 19 nt, Artificial Sequence
  Synthetic oligonucleotide
uggccuccuaccaggcugc

SEQ ID NO: 2505 - RNA, 19 nt, Artificial Sequence
  Synthetic oligonucleotide
ggccuccuaccaggcugcg

SEQ ID NO: 2506 - RNA, 19 nt, Artificial Sequence
  Synthetic oligonucleotide
gccuccuaccaggcugcgc

SEQ ID NO: 2507 - RNA, 19 nt, Artificial Sequence
  Synthetic oligonucleotide
ccuccuaccaggcugcgcg

SEQ ID NO: 2508 - RNA, 19 nt, Artificial Sequence
  Synthetic oligonucleotide
cuccuaccaggcugcgcgc

SEQ ID NO: 2509 - RNA, 19 nt, Artificial Sequence
  Synthetic oligonucleotide
uccuaccaggcugcgcgca

SEQ ID NO: 2510 - RNA, 19 nt, Artificial Sequence
  Synthetic oligonucleotide
ccuaccaggcugcgcgcaa

SEQ ID NO: 2511 - RNA, 19 nt, Artificial Sequence
  Synthetic oligonucleotide
cuaccaggcugcgcgcaaa

SEQ ID NO: 2512 - RNA, 19 nt, Artificial Sequence
  Synthetic oligonucleotide
uaccaggcugcgcgcaaag

SEQ ID NO: 2513 - RNA, 19 nt, Artificial Sequence
  Synthetic oligonucleotide
accaggcugcgcgcaaaga

SEQ ID NO: 2514 - RNA, 19 nt, Artificial Sequence
  Synthetic oligonucleotide
ccaggcugcgcgcaaagac

SEQ ID NO: 2515 - RNA, 19 nt, Artificial Sequence
  Synthetic oligonucleotide
caggcugcgcgcaaagaca

SEQ ID NO: 2516 - RNA, 19 nt, Artificial Sequence
  Synthetic oligonucleotide
aggcugcgcgcaaagacag

SEQ ID NO: 2517 - RNA, 19 nt, Artificial Sequence
  Synthetic oligonucleotide
ggcugcgcgcaaagacagc

SEQ ID NO: 2518 - RNA, 19 nt, Artificial Sequence
  Synthetic oligonucleotide
cacagcgucugcuccaccu

SEQ ID NO: 2519 - RNA, 19 nt, Artificial Sequence
  Synthetic oligonucleotide
acagcgucugcuccaccuc

SEQ ID NO: 2520 - RNA, 19 nt, Artificial Sequence
  Synthetic oligonucleotide
cagcgucugcuccaccucc

SEQ ID NO: 2521 - RNA, 19 nt, Artificial Sequence
  Synthetic oligonucleotide
agcgucugcuccaccucca

SEQ ID NO: 2522 - RNA, 19 nt, Artificial Sequence
  Synthetic oligonucleotide
gcgucugcuccaccuccag

SEQ ID NO: 2523 - RNA, 19 nt, Artificial Sequence
  Synthetic oligonucleotide
cgucugcuccaccuccagc

SEQ ID NO: 2524 - RNA, 19 nt, Artificial Sequence
  Synthetic oligonucleotide
cucaacgacagcagcucgc

SEQ ID NO: 2525 - RNA, 19 nt, Artificial Sequence
  Synthetic oligonucleotide
ucaacgacagcagcucgcc

SEQ ID NO: 2526 - RNA, 19 nt, Artificial Sequence
  Synthetic oligonucleotide
caacgacagcagcucgccc

SEQ ID NO: 2527 - RNA, 19 nt, Artificial Sequence
  Synthetic oligonucleotide
aacgacagcagcucgccca

SEQ ID NO: 2528 - RNA, 19 nt, Artificial Sequence
  Synthetic oligonucleotide
acgacagcagcucgcccaa

SEQ ID NO: 2529 - RNA, 19 nt, Artificial Sequence
  Synthetic oligonucleotide
caugaggagacaccgccca

SEQ ID NO: 2530 - RNA, 19 nt, Artificial Sequence
  Synthetic oligonucleotide
augaggagacaccgcccac

SEQ ID NO: 2531 - RNA, 19 nt, Artificial Sequence
  Synthetic oligonucleotide
ugaggagacaccgcccacc

SEQ ID NO: 2532 - RNA, 19 nt, Artificial Sequence
  Synthetic oligonucleotide
gaggagacaccgcccacca

SEQ ID NO: 2533 - RNA, 19 nt, Artificial Sequence
  Synthetic oligonucleotide
aggagacaccgcccaccac

SEQ ID NO: 2534 - RNA, 19 nt, Artificial Sequence
  Synthetic oligonucleotide
ggagacaccgcccaccacc

SEQ ID NO: 2535 - RNA, 19 nt, Artificial Sequence
  Synthetic oligonucleotide
gagacaccgcccaccacca

SEQ ID NO: 2536 - RNA, 19 nt, Artificial Sequence
  Synthetic oligonucleotide
agacaccgcccaccaccag

SEQ ID NO: 2537 - RNA, 19 nt, Artificial Sequence
  Synthetic oligonucleotide
gacaccgcccaccaccagc

SEQ ID NO: 2538 - RNA, 19 nt, Artificial Sequence
  Synthetic oligonucleotide
acaccgcccaccaccagca

SEQ ID NO: 2539 - RNA, 19 nt, Artificial Sequence
  Synthetic oligonucleotide
caccgcccaccaccagcag

SEQ ID NO: 2540 - RNA, 19 nt, Artificial Sequence
  Synthetic oligonucleotide
accgcccaccaccagcagc

SEQ ID NO: 2541 - RNA, 19 nt, Artificial Sequence
  Synthetic oligonucleotide
ccgcccaccaccagcagcg

SEQ ID NO: 2542 - RNA, 19 nt, Artificial Sequence
  Synthetic oligonucleotide
cgcccaccaccagcagcga

SEQ ID NO: 2543 - RNA, 19 nt, Artificial Sequence
  Synthetic oligonucleotide
gcccaccaccagcagcgac

SEQ ID NO: 2544 - RNA, 19 nt, Artificial Sequence
  Synthetic oligonucleotide
cccaccaccagcagcgacu

SEQ ID NO: 2545 - RNA, 19 nt, Artificial Sequence
  Synthetic oligonucleotide
ccaccaccagcagcgacuc

SEQ ID NO: 2546 - RNA, 19 nt, Artificial Sequence
  Synthetic oligonucleotide
caccaccagcagcgacucu

SEQ ID NO: 2547 - RNA, 19 nt, Artificial Sequence
  Synthetic oligonucleotide
accaccagcagcgacucug

SEQ ID NO: 2548 - RNA, 19 nt, Artificial Sequence
  Synthetic oligonucleotide
ccaccagcagcgacucuga

SEQ ID NO: 2549 - RNA, 19 nt, Artificial Sequence
  Synthetic oligonucleotide
caagaagaugaggaagaaa

SEQ ID NO: 2550 - RNA, 19 nt, Artificial Sequence
  Synthetic oligonucleotide
aagaagaugaggaagaaau

SEQ ID NO: 2551 - RNA, 19 nt, Artificial Sequence
  Synthetic oligonucleotide
gaggccacagcaaaccucc

SEQ ID NO: 2552 - RNA, 19 nt, Artificial Sequence
  Synthetic oligonucleotide
cacagcccacugguccuca

SEQ ID NO: 2553 - RNA, 19 nt, Artificial Sequence
  Synthetic oligonucleotide
acagcccacugguccucaa

SEQ ID NO: 2554 - RNA, 19 nt, Artificial Sequence
  Synthetic oligonucleotide
cagcccacugguccucaag

SEQ ID NO: 2555 - RNA, 19 nt, Artificial Sequence
  Synthetic oligonucleotide
agcccacugguccucaaga

SEQ ID NO: 2556 - RNA, 19 nt, Artificial Sequence
  Synthetic oligonucleotide
gcccacugguccucaagag

SEQ ID NO: 2557 - RNA, 19 nt, Artificial Sequence
  Synthetic oligonucleotide
cccacugguccucaagagg

SEQ ID NO: 2558 - RNA, 19 nt, Artificial Sequence
  Synthetic oligonucleotide
ccacugguccucaagaggu

SEQ ID NO: 2559 - RNA, 19 nt, Artificial Sequence
  Synthetic oligonucleotide
cacugguccucaagaggug

SEQ ID NO: 2560 - RNA, 19 nt, Artificial Sequence
  Synthetic oligonucleotide
acugguccucaagaggugc

SEQ ID NO: 2561 - RNA, 19 nt, Artificial Sequence
  Synthetic oligonucleotide
cugguccucaagaggugcc

SEQ ID NO: 2562 - RNA, 19 nt, Artificial Sequence
  Synthetic oligonucleotide
ugguccucaagaggugcca

SEQ ID NO: 2563 - RNA, 19 nt, Artificial Sequence
  Synthetic oligonucleotide
gguccucaagaggugccac

SEQ ID NO: 2564 - RNA, 19 nt, Artificial Sequence
  Synthetic oligonucleotide
guccucaagaggugccacg

SEQ ID NO: 2565 - RNA, 19 nt, Artificial Sequence
  Synthetic oligonucleotide
uccucaagaggugccacgu

SEQ ID NO: 2566 - RNA, 19 nt, Artificial Sequence
  Synthetic oligonucleotide
ccucaagaggugccacguc

SEQ ID NO: 2567 - RNA, 19 nt, Artificial Sequence
  Synthetic oligonucleotide
cucaagaggugccacgucu

SEQ ID NO: 2568 - RNA, 19 nt, Artificial Sequence
  Synthetic oligonucleotide
agcuuuuuugcccugcgug

SEQ ID NO: 2569 - RNA, 19 nt, Artificial Sequence
  Synthetic oligonucleotide
gcuuuuuugcccugcguga

SEQ ID NO: 2570 - RNA, 19 nt, Artificial Sequence
  Synthetic oligonucleotide
cuuuuuugcccugcgugac

SEQ ID NO: 2571 - RNA, 19 nt, Artificial Sequence
  Synthetic oligonucleotide
uuuuuugcccugcgugacc

SEQ ID NO: 2572 - RNA, 19 nt, Artificial Sequence
  Synthetic oligonucleotide
uuuuugcccugcgugacca

SEQ ID NO: 2573 - RNA, 19 nt, Artificial Sequence
  Synthetic oligonucleotide
uuuugcccugcgugaccag

SEQ ID NO: 2574 - RNA, 19 nt, Artificial Sequence
  Synthetic oligonucleotide
uuugcccugcgugaccaga

SEQ ID NO: 2575 - RNA, 19 nt, Artificial Sequence
  Synthetic oligonucleotide
uugcccugcgugaccagau

SEQ ID NO: 2576 - RNA, 19 nt, Artificial Sequence
  Synthetic oligonucleotide
ugcccugcgugaccagauc

SEQ ID NO: 2577 - RNA, 19 nt, Artificial Sequence
  Synthetic oligonucleotide
gcccugcgugaccagaucc

SEQ ID NO: 2578 - RNA, 19 nt, Artificial Sequence
  Synthetic oligonucleotide
cccugcgugaccagauccc

SEQ ID NO: 2579 - RNA, 19 nt, Artificial Sequence
  Synthetic oligonucleotide
ggaaacgacgagaacaguu

SEQ ID NO: 2580 - RNA, 19 nt, Artificial Sequence
  Synthetic oligonucleotide
gaaacgacgagaacaguug

SEQ ID NO: 2581 - RNA, 19 nt, Artificial Sequence
  Synthetic oligonucleotide
uuuaacagauuuguauuua

SEQ ID NO: 2582 - RNA, 19 nt, Artificial Sequence
  Synthetic oligonucleotide
uuaacagauuuguauuuaa

SEQ ID NO: 2583 - RNA, 19 nt, Artificial Sequence
  Synthetic oligonucleotide
aaauguaaauaacuuuaau

SEQ ID NO: 2584 - RNA, 19 nt, Artificial Sequence
  Synthetic oligonucleotide
aauguaaauaacuuuaaua

SEQ ID NO: 2585 - RNA, 19 nt, Artificial Sequence
  Synthetic oligonucleotide
auguaaauaacuuuaauaa

SEQ ID NO: 2586 - RNA, 19 nt, Artificial Sequence
  Synthetic oligonucleotide
uguaaauaacuuuaauaaa

SEQ ID NO: 2587 - RNA, 19 nt, Artificial Sequence
  Synthetic oligonucleotide
guaaauaacuuuaauaaaa

SEQ ID NO: 2588 - RNA, 19 nt, Artificial Sequence
  Synthetic oligonucleotide
uaaauaacuuuaauaaaac

SEQ ID NO: 2589 - RNA, 19 nt, Artificial Sequence
  Synthetic oligonucleotide
aaauaacuuuaauaaaacg

SEQ ID NO: 2590 - RNA, 19 nt, Artificial Sequence
  Synthetic oligonucleotide
aauaacuuuaauaaaacgu

SEQ ID NO: 2591 - RNA, 19 nt, Artificial Sequence
  Synthetic oligonucleotide
auaacuuuaauaaaacguu

SEQ ID NO: 2592 - RNA, 19 nt, Artificial Sequence
  Synthetic oligonucleotide
uaacuuuaauaaaacguuu

SEQ ID NO: 2593 - RNA, 19 nt, Artificial Sequence
  Synthetic oligonucleotide
aacuuuaauaaaacguuua

SEQ ID NO: 2594 - RNA, 19 nt, Artificial Sequence
  Synthetic oligonucleotide
acuuuaauaaaacguuuau

SEQ ID NO: 2595 - RNA, 19 nt, Artificial Sequence
  Synthetic oligonucleotide
cuuuaauaaaacguuuaua

SEQ ID NO: 2596 - RNA, 19 nt, Artificial Sequence
  Synthetic oligonucleotide
uuuuuaaaguugauuuuuu

SEQ ID NO: 2597 - RNA, 19 nt, Artificial Sequence
  Synthetic oligonucleotide
uuuuaaaguugauuuuuuu

SEQ ID NO: 2598 - RNA, 19 nt, Artificial Sequence
  Synthetic oligonucleotide
uuuaaaguugauuuuuuuc

SEQ ID NO: 2599 - RNA, 19 nt, Artificial Sequence
  Synthetic oligonucleotide
uuaaaguugauuuuuuucu

SEQ ID NO: 2600 - RNA, 19 nt, Artificial Sequence
  Synthetic oligonucleotide
uaaaguugauuuuuuucua

SEQ ID NO: 2601 - RNA, 19 nt, Artificial Sequence
  Synthetic oligonucleotide
aaaguugauuuuuuucuau

SEQ ID NO: 2602 - RNA, 19 nt, Artificial Sequence
  Synthetic oligonucleotide
aaguugauuuuuuucuauu

SEQ ID NO: 2603 - RNA, 19 nt, Artificial Sequence
  Synthetic oligonucleotide
aguugauuuuuuucuauug

SEQ ID NO: 2604 - RNA, 19 nt, Artificial Sequence
  Synthetic oligonucleotide
guugauuuuuuucuauugu

SEQ ID NO: 2605 - RNA, 19 nt, Artificial Sequence
  Synthetic oligonucleotide
uugauuuuuuucuauuguu

SEQ ID NO: 2606 - RNA, 19 nt, Artificial Sequence
  Synthetic oligonucleotide
ugauuuuuuucuauuguuu

SEQ ID NO: 2607 - RNA, 19 nt, Artificial Sequence
  Synthetic oligonucleotide
gauuuuuuucuauuguuuu

SEQ ID NO: 2608 - RNA, 19 nt, Artificial Sequence
  Synthetic oligonucleotide
auuuuuuucuauuguuuuu

SEQ ID NO: 2609 - RNA, 19 nt, Artificial Sequence
  Synthetic oligonucleotide
uuuuuuucuauuguuuuua

SEQ ID NO: 2610 - RNA, 19 nt, Artificial Sequence
  Synthetic oligonucleotide
uuuuuucuauuguuuuuag

SEQ ID NO: 2611 - RNA, 19 nt, Artificial Sequence
  Synthetic oligonucleotide
uuuuucuauuguuuuuaga

SEQ ID NO: 2612 - RNA, 19 nt, Artificial Sequence
  Synthetic oligonucleotide
uuuucuauuguuuuuagaa

SEQ ID NO: 2613 - RNA, 19 nt, Artificial Sequence
  Synthetic oligonucleotide
uuucuauuguuuuuagaaa

SEQ ID NO: 2614 - RNA, 19 nt, Artificial Sequence
  Synthetic oligonucleotide
uucuauuguuuuuagaaaa

SEQ ID NO: 2615 - RNA, 19 nt, Artificial Sequence
  Synthetic oligonucleotide
ucuauuguuuuuagaaaaa

SEQ ID NO: 2616 - RNA, 19 nt, Artificial Sequence
  Synthetic oligonucleotide
cuauuguuuuuagaaaaaa

SEQ ID NO: 2617 - RNA, 19 nt, Artificial Sequence
  Synthetic oligonucleotide
ucgagaagggcagggcuuc

SEQ ID NO: 2618 - RNA, 19 nt, Artificial Sequence
  Synthetic oligonucleotide
ggcuuuaucuaacucgcug

SEQ ID NO: 2619 - RNA, 19 nt, Artificial Sequence
  Synthetic oligonucleotide
acccuugccgcauccacga

SEQ ID NO: 2620 - RNA, 19 nt, Artificial Sequence
  Synthetic oligonucleotide
ugccgcauccacgaaacuu

SEQ ID NO: 2621 - RNA, 19 nt, Artificial Sequence
  Synthetic oligonucleotide
auccacgaaacuuugccca

SEQ ID NO: 2622 - RNA, 19 nt, Artificial Sequence
  Synthetic oligonucleotide
ggcgggcacuuugcacugg

SEQ ID NO: 2623 - RNA, 19 nt, Artificial Sequence
  Synthetic oligonucleotide
cacuuugcacuggaacuua

SEQ ID NO: 2624 - RNA, 19 nt, Artificial Sequence
  Synthetic oligonucleotide
acuggaacuuacaacaccc

SEQ ID NO: 2625 - RNA, 19 nt, Artificial Sequence
  Synthetic oligonucleotide
ugcagcugcuuagacgcug

SEQ ID NO: 2626 - RNA, 19 nt, Artificial Sequence
  Synthetic oligonucleotide
ugcuuagacgcuggauuuu

SEQ ID NO: 2627 - RNA, 19 nt, Artificial Sequence
  Synthetic oligonucleotide
acgcuggauuuuuuucggg

SEQ ID NO: 2628 - RNA, 19 nt, Artificial Sequence
  Synthetic oligonucleotide
ggauuuuuuucggguagug

SEQ ID NO: 2629 - RNA, 19 nt, Artificial Sequence
  Synthetic oligonucleotide
ucggguaguggaaaaccag

SEQ ID NO: 2630 - RNA, 19 nt, Artificial Sequence
  Synthetic oligonucleotide
ccucaacguuagcuucacc

SEQ ID NO: 2631 - RNA, 19 nt, Artificial Sequence
  Synthetic oligonucleotide
cguuagcuucaccaacagg

SEQ ID NO: 2632 - RNA, 19 nt, Artificial Sequence
  Synthetic oligonucleotide
cgacucggugcagccguau

SEQ ID NO: 2633 - RNA, 19 nt, Artificial Sequence
  Synthetic oligonucleotide
ugcagccguauuucuacug

SEQ ID NO: 2634 - RNA, 19 nt, Artificial Sequence
  Synthetic oligonucleotide
ggaggagaacuucuaccag

SEQ ID NO: 2635 - RNA, 19 nt, Artificial Sequence
  Synthetic oligonucleotide
agcgaggauaucuggaaga

SEQ ID NO: 2636 - RNA, 19 nt, Artificial Sequence
  Synthetic oligonucleotide
acguugcggucacacccuu

SEQ ID NO: 2637 - RNA, 19 nt, Artificial Sequence
  Synthetic oligonucleotide
gacauggugaaccagaguu

SEQ ID NO: 2638 - RNA, 19 nt, Artificial Sequence
  Synthetic oligonucleotide
cccggacgacgagaccuuc

SEQ ID NO: 2639 - RNA, 19 nt, Artificial Sequence
  Synthetic oligonucleotide
cgagaccuucaucaaaaac

SEQ ID NO: 2640 - RNA, 19 nt, Artificial Sequence
  Synthetic oligonucleotide
caaaaacaucaucauccag

SEQ ID NO: 2641 - RNA, 19 nt, Artificial Sequence
  Synthetic oligonucleotide
aggacuguauguggagcgg

SEQ ID NO: 2642 - RNA, 19 nt, Artificial Sequence
  Synthetic oligonucleotide
ucugcuccaccuccagcuu

SEQ ID NO: 2643 - RNA, 19 nt, Artificial Sequence
  Synthetic oligonucleotide
caccuccagcuuguaccug

SEQ ID NO: 2644 - RNA, 19 nt, Artificial Sequence
  Synthetic oligonucleotide
ccagcuuguaccugcagga

SEQ ID NO: 2645 - RNA, 19 nt, Artificial Sequence
  Synthetic oligonucleotide
caaguccugcgccucgcaa

SEQ ID NO: 2646 - RNA, 19 nt, Artificial Sequence
  Synthetic oligonucleotide
agcagcgacucugaggagg

SEQ ID NO: 2647 - RNA, 19 nt, Artificial Sequence
  Synthetic oligonucleotide
gacucugaggaggaacaag

SEQ ID NO: 2648 - RNA, 19 nt, Artificial Sequence
  Synthetic oligonucleotide
ugaggaggaacaagaagau

SEQ ID NO: 2649 - RNA, 19 nt, Artificial Sequence
  Synthetic oligonucleotide
gaacaagaagaugaggaag

SEQ ID NO: 2650 - RNA, 19 nt, Artificial Sequence
  Synthetic oligonucleotide
gaagaugaggaagaaaucg

SEQ ID NO: 2651 - RNA, 19 nt, Artificial Sequence
  Synthetic oligonucleotide
gaggaagaaaucgauguug

SEQ ID NO: 2652 - RNA, 19 nt, Artificial Sequence
  Synthetic oligonucleotide
gaaaucgauguuguuucug

SEQ ID NO: 2653 - RNA, 19 nt, Artificial Sequence
  Synthetic oligonucleotide
gauguuguuucuguggaaa

SEQ ID NO: 2654 - RNA, 19 nt, Artificial Sequence
  Synthetic oligonucleotide
agaggcaggcuccuggcaa

SEQ ID NO: 2655 - RNA, 19 nt, Artificial Sequence
  Synthetic oligonucleotide
caggcuccuggcaaaaggu

SEQ ID NO: 2656 - RNA, 19 nt, Artificial Sequence
  Synthetic oligonucleotide
uccuggcaaaaggucagag

SEQ ID NO: 2657 - RNA, 19 nt, Artificial Sequence
  Synthetic oligonucleotide
gcaaaaggucagagucugg

SEQ ID NO: 2658 - RNA, 19 nt, Artificial Sequence
  Synthetic oligonucleotide
aggucagagucuggaucac

SEQ ID NO: 2659 - RNA, 19 nt, Artificial Sequence
  Synthetic oligonucleotide
agcaaaccuccucacagcc

SEQ ID NO: 2660 - RNA, 19 nt, Artificial Sequence
  Synthetic oligonucleotide
uccucacagcccacugguc

SEQ ID NO: 2661 - RNA, 19 nt, Artificial Sequence
  Synthetic oligonucleotide
ucccuccacucggaaggac

SEQ ID NO: 2662 - RNA, 19 nt, Artificial Sequence
  Synthetic oligonucleotide
acucggaaggacuauccug

SEQ ID NO: 2663 - RNA, 19 nt, Artificial Sequence
  Synthetic oligonucleotide
uauccugcugccaagaggg

SEQ ID NO: 2664 - RNA, 19 nt, Artificial Sequence
  Synthetic oligonucleotide
ugcugccaagagggucaag

SEQ ID NO: 2665 - RNA, 19 nt, Artificial Sequence
  Synthetic oligonucleotide
ccaagagggucaaguugga

SEQ ID NO: 2666 - RNA, 19 nt, Artificial Sequence
  Synthetic oligonucleotide
agggucaaguuggacagug

SEQ ID NO: 2667 - RNA, 19 nt, Artificial Sequence
  Synthetic oligonucleotide
caaguuggacagugucaga

SEQ ID NO: 2668 - RNA, 19 nt, Artificial Sequence
  Synthetic oligonucleotide
uggacagugucagaguccu

SEQ ID NO: 2669 - RNA, 19 nt, Artificial Sequence
  Synthetic oligonucleotide
ucagaguccugagacagau

SEQ ID NO: 2670 - RNA, 19 nt, Artificial Sequence
  Synthetic oligonucleotide
ugagacagaucagcaacaa

SEQ ID NO: 2671 - RNA, 19 nt, Artificial Sequence
  Synthetic oligonucleotide
agaucagcaacaaccgaaa

SEQ ID NO: 2672 - RNA, 19 nt, Artificial Sequence
  Synthetic oligonucleotide
uccucggacaccgaggaga

SEQ ID NO: 2673 - RNA, 19 nt, Artificial Sequence
  Synthetic oligonucleotide
ggacaccgaggagaauguc

SEQ ID NO: 2674 - RNA, 19 nt, Artificial Sequence
  Synthetic oligonucleotide
ccagaggaggaacgagcua

SEQ ID NO: 2675 - RNA, 19 nt, Artificial Sequence
  Synthetic oligonucleotide
gaggaacgagcuaaaacgg

SEQ ID NO: 2676 - RNA, 19 nt, Artificial Sequence
  Synthetic oligonucleotide
acgagcuaaaacggagcuu

SEQ ID NO: 2677 - RNA, 19 nt, Artificial Sequence
  Synthetic oligonucleotide
uaaaacggagcuuuuuugc

SEQ ID NO: 2678 - RNA, 19 nt, Artificial Sequence
  Synthetic oligonucleotide
cggagcuuuuuugcccugc

SEQ ID NO: 2679 - RNA, 19 nt, Artificial Sequence
  Synthetic oligonucleotide
ugaccagaucccggaguug

SEQ ID NO: 2680 - RNA, 19 nt, Artificial Sequence
  Synthetic oligonucleotide
agaucccggaguuggaaaa

SEQ ID NO: 2681 - RNA, 19 nt, Artificial Sequence
  Synthetic oligonucleotide
ccggaguuggaaaacaaug

SEQ ID NO: 2682 - RNA, 19 nt, Artificial Sequence
  Synthetic oligonucleotide
aagguaguuauccuuaaaa

SEQ ID NO: 2683 - RNA, 19 nt, Artificial Sequence
  Synthetic oligonucleotide
aguuauccuuaaaaaagcc

SEQ ID NO: 2684 - RNA, 19 nt, Artificial Sequence
  Synthetic oligonucleotide
uccuuaaaaaagccacagc

SEQ ID NO: 2685 - RNA, 19 nt, Artificial Sequence
  Synthetic oligonucleotide
aaaaaagccacagcauaca

SEQ ID NO: 2686 - RNA, 19 nt, Artificial Sequence
  Synthetic oligonucleotide
agccacagcauacauccug

SEQ ID NO: 2687 - RNA, 19 nt, Artificial Sequence
  Synthetic oligonucleotide
agcauacauccuguccguc

SEQ ID NO: 2688 - RNA, 19 nt, Artificial Sequence
  Synthetic oligonucleotide
uccuguccguccaagcaga

SEQ ID NO: 2689 - RNA, 19 nt, Artificial Sequence
  Synthetic oligonucleotide
uccguccaagcagaggagc

SEQ ID NO: 2690 - RNA, 19 nt, Artificial Sequence
  Synthetic oligonucleotide
agcagaggagcaaaagcuc

SEQ ID NO: 2691 - RNA, 19 nt, Artificial Sequence
  Synthetic oligonucleotide
gagcaaaagcucauuucug

SEQ ID NO: 2692 - RNA, 19 nt, Artificial Sequence
  Synthetic oligonucleotide
aaagcucauuucugaagag

SEQ ID NO: 2693 - RNA, 19 nt, Artificial Sequence
  Synthetic oligonucleotide
cauuucugaagaggacuug

SEQ ID NO: 2694 - RNA, 19 nt, Artificial Sequence
  Synthetic oligonucleotide
ugaagaggacuuguugcgg

SEQ ID NO: 2695 - RNA, 19 nt, Artificial Sequence
  Synthetic oligonucleotide
aggacuuguugcggaaacg

SEQ ID NO: 2696 - RNA, 19 nt, Artificial Sequence
  Synthetic oligonucleotide
uuguugcggaaacgacgag

SEQ ID NO: 2697 - RNA, 19 nt, Artificial Sequence
  Synthetic oligonucleotide
gcggaaacgacgagaacag

SEQ ID NO: 2698 - RNA, 19 nt, Artificial Sequence
  Synthetic oligonucleotide
caaacuugaacagcuacgg

SEQ ID NO: 2699 - RNA, 19 nt, Artificial Sequence
  Synthetic oligonucleotide
ugaacagcuacggaacucu

SEQ ID NO: 2700 - RNA, 19 nt, Artificial Sequence
  Synthetic oligonucleotide
agcuacggaacucuugugc

SEQ ID NO: 2701 - RNA, 19 nt, Artificial Sequence
  Synthetic oligonucleotide
gaacucuugugcguaagga

SEQ ID NO: 2702 - RNA, 19 nt, Artificial Sequence
  Synthetic oligonucleotide
uugugcguaaggaaaagua

SEQ ID NO: 2703 - RNA, 19 nt, Artificial Sequence
  Synthetic oligonucleotide
cguaaggaaaaguaaggaa

SEQ ID NO: 2704 - RNA, 19 nt, Artificial Sequence
  Synthetic oligonucleotide
aguaaggaaaacgauuccu

SEQ ID NO: 2705 - RNA, 19 nt, Artificial Sequence
  Synthetic oligonucleotide
ggaaaacgauuccuucuaa

SEQ ID NO: 2706 - RNA, 19 nt, Artificial Sequence
  Synthetic oligonucleotide
acgauuccuucuaacagaa

SEQ ID NO: 2707 - RNA, 19 nt, Artificial Sequence
  Synthetic oligonucleotide
ccuucuaacagaaaugucc

SEQ ID NO: 2708 - RNA, 19 nt, Artificial Sequence
  Synthetic oligonucleotide
acagaaauguccugagcaa

SEQ ID NO: 2709 - RNA, 19 nt, Artificial Sequence
  Synthetic oligonucleotide
uccugagcaaucaccuaug

SEQ ID NO: 2710 - RNA, 19 nt, Artificial Sequence
  Synthetic oligonucleotide
gcaaucaccuaugaacuug

SEQ ID NO: 2711 - RNA, 19 nt, Artificial Sequence
  Synthetic oligonucleotide
accuaugaacuuguuucaa

SEQ ID NO: 2712 - RNA, 19 nt, Artificial Sequence
  Synthetic oligonucleotide
ugaacuuguuucaaaugca

SEQ ID NO: 2713 - RNA, 19 nt, Artificial Sequence
  Synthetic oligonucleotide
uguuucaaaugcaugauca

SEQ ID NO: 2714 - RNA, 19 nt, Artificial Sequence
  Synthetic oligonucleotide
caaaugcaugaucaaaugc

SEQ ID NO: 2715 - RNA, 19 nt, Artificial Sequence
  Synthetic oligonucleotide
ugaucaaaugcaaccucac

SEQ ID NO: 2716 - RNA, 19 nt, Artificial Sequence
  Synthetic oligonucleotide
aaaugcaaccucacaaccu

SEQ ID NO: 2717 - RNA, 19 nt, Artificial Sequence
  Synthetic oligonucleotide
accucacaaccuuggcuga

SEQ ID NO: 2718 - RNA, 19 nt, Artificial Sequence
  Synthetic oligonucleotide
acaaccuuggcugagucuu

SEQ ID NO: 2719 - RNA, 19 nt, Artificial Sequence
  Synthetic oligonucleotide
uggcugagucuugagacug

SEQ ID NO: 2720 - RNA, 19 nt, Artificial Sequence
  Synthetic oligonucleotide
agucuugagacugaaagau

SEQ ID NO: 2721 - RNA, 19 nt, Artificial Sequence
  Synthetic oligonucleotide
agacugaaagauuuagcca

SEQ ID NO: 2722 - RNA, 19 nt, Artificial Sequence
  Synthetic oligonucleotide
gaaagauuuagccauaaug

SEQ ID NO: 2723 - RNA, 19 nt, Artificial Sequence
  Synthetic oligonucleotide
agccauaauguaaacugcc

SEQ ID NO: 2724 - RNA, 19 nt, Artificial Sequence
  Synthetic oligonucleotide
uguaaacugccucaaauug

SEQ ID NO: 2725 - RNA, 19 nt, Artificial Sequence
  Synthetic oligonucleotide
cugccucaaauuggacuuu

SEQ ID NO: 2726 - RNA, 19 nt, Artificial Sequence
  Synthetic oligonucleotide
ucaaauuggacuuugggca

SEQ ID NO: 2727 - RNA, 19 nt, Artificial Sequence
  Synthetic oligonucleotide
ggacuuugggcauaaaaga

SEQ ID NO: 2728 - RNA, 19 nt, Artificial Sequence
  Synthetic oligonucleotide
gggcauaaaagaacuuuuu

SEQ ID NO: 2729 - RNA, 19 nt, Artificial Sequence
  Synthetic oligonucleotide
uaaaagaacuuuuuuaugc

SEQ ID NO: 2730 - RNA, 19 nt, Artificial Sequence
  Synthetic oligonucleotide
gaacuuuuuuaugcuuacc

SEQ ID NO: 2731 - RNA, 19 nt, Artificial Sequence
  Synthetic oligonucleotide
uuuuaugcuuaccaucuuu

SEQ ID NO: 2732 - RNA, 19 nt, Artificial Sequence
  Synthetic oligonucleotide
ugcuuaccaucuuuuuuuu

SEQ ID NO: 2733 - RNA, 19 nt, Artificial Sequence
  Synthetic oligonucleotide
accaucuuuuuuuuuucuu

SEQ ID NO: 2734 - RNA, 19 nt, Artificial Sequence
  Synthetic oligonucleotide
uuuuuuuuuucuuuaacag

SEQ ID NO: 2735 - RNA, 19 nt, Artificial Sequence
  Synthetic oligonucleotide
ucuuuaacagauuuguauu

SEQ ID NO: 2736 - RNA, 19 nt, Artificial Sequence
  Synthetic oligonucleotide
acagauuuguauuuaagaa

SEQ ID NO: 2737 - RNA, 19 nt, Artificial Sequence
  Synthetic oligonucleotide
guauuuaagaauuguuuuu

SEQ ID NO: 2738 - RNA, 19 nt, Artificial Sequence
  Synthetic oligonucleotide
agaauuguuuuuaaaaaau

SEQ ID NO: 2739 - RNA, 19 nt, Artificial Sequence
  Synthetic oligonucleotide
caauguuucucuguaaaua

SEQ ID NO: 2740 - RNA, 19 nt, Artificial Sequence
  Synthetic oligonucleotide
ucuguaaauauugccauua

SEQ ID NO: 2741 - RNA, 19 nt, Artificial Sequence
  Synthetic oligonucleotide
aaauauugccauuaaaugu

SEQ ID NO: 2742 - RNA, 19 nt, Artificial Sequence
  Synthetic oligonucleotide
gccauuaaauguaaauaac

SEQ ID NO: 2743 - RNA, 19 nt, Artificial Sequence
  Synthetic oligonucleotide
uuuaauaaaacguuuauag

SEQ ID NO: 2744 - RNA, 19 nt, Artificial Sequence
  Synthetic oligonucleotide
acagaauuucaauccuagu

SEQ ID NO: 2745 - RNA, 19 nt, Artificial Sequence
  Synthetic oligonucleotide
ccuaguauuauagguacua

SEQ ID NO: 2746 - RNA, 19 nt, Artificial Sequence
  Synthetic oligonucleotide
uuauagguacuauaaaccc

SEQ ID NO: 2747 - RNA, 19 nt, Artificial Sequence
  Synthetic oligonucleotide
uacuauaaacccuaauuuu

SEQ ID NO: 2748 - RNA, 19 nt, Artificial Sequence
  Synthetic oligonucleotide
acccuaauuuuuuuuauuu

SEQ ID NO: 2749 - RNA, 19 nt, Artificial Sequence
  Synthetic oligonucleotide
aauuuuuuuuauuuaagua

SEQ ID NO: 2750 - RNA, 19 nt, Artificial Sequence
  Synthetic oligonucleotide
uuauuuaaguacauuuugc

SEQ ID NO: 2751 - RNA, 19 nt, Artificial Sequence
  Synthetic oligonucleotide
uaaguacauuuugcuuuuu

SEQ ID NO: 2752 - RNA, 19 nt, Artificial Sequence
  Synthetic oligonucleotide
cauuuugcuuuuuaaaguu

SEQ ID NO: 2753 - RNA, 19 nt, Artificial Sequence
  Synthetic oligonucleotide
gcuuuuuaaaguugauuuu

SEQ ID NO: 2754 - RNA, 19 nt, Artificial Sequence
  Synthetic oligonucleotide
cuauuguuuuuagaaaaaa

SEQ ID NO: 2755 - RNA, 19 nt, Artificial Sequence
  Synthetic oligonucleotide
guuuuuagaaaaaauaaaa

SEQ ID NO: 2756 - RNA, 19 nt, Artificial Sequence
  Synthetic oligonucleotide
aaaaaauaaaauaacuggc

SEQ ID NO: 2757 - RNA, 19 nt, Artificial Sequence
  Synthetic oligonucleotide
aaauaacuggcaaauauau

SEQ ID NO: 2758 - RNA, 19 nt, Artificial Sequence
  Synthetic oligonucleotide
gcaaauauaucauugagcc

SEQ ID NO: 2759 - RNA, 19 nt, Artificial Sequence
  Synthetic oligonucleotide
uaucauugagccaaaucuu

SEQ ID NO: 2760 - RNA, 19 nt, Artificial Sequence
  Synthetic oligonucleotide
ugagccaaaucuuaaaaaa

SEQ ID NO: 2761 - RNA, 19 nt, Artificial Sequence
  Synthetic oligonucleotide
aacucgcuguaguaauucc

SEQ ID NO: 2762 - RNA, 19 nt, Artificial Sequence
  Synthetic oligonucleotide
acucgcuguaguaauucca

SEQ ID NO: 2763 - RNA, 19 nt, Artificial Sequence
  Synthetic oligonucleotide
cucgcuguaguaauuccag

SEQ ID NO: 2764 - RNA, 19 nt, Artificial Sequence
  Synthetic oligonucleotide
ucgcuguaguaauuccagc

SEQ ID NO: 2765 - RNA, 19 nt, Artificial Sequence
  Synthetic oligonucleotide
cgcuguaguaauuccagcg

SEQ ID NO: 2766 - RNA, 19 nt, Artificial Sequence
  Synthetic oligonucleotide
gcuguaguaauuccagcga

SEQ ID NO: 2767 - RNA, 19 nt, Artificial Sequence
  Synthetic oligonucleotide
cuguaguaauuccagcgag

SEQ ID NO: 2768 - RNA, 19 nt, Artificial Sequence
  Synthetic oligonucleotide
uguaguaauuccagcgaga

SEQ ID NO: 2769 - RNA, 19 nt, Artificial Sequence
  Synthetic oligonucleotide
gcuucaccaacaggaacua

SEQ ID NO: 2770 - RNA, 19 nt, Artificial Sequence
  Synthetic oligonucleotide
cuucaccaacaggaacuau

SEQ ID NO: 2771 - RNA, 19 nt, Artificial Sequence
  Synthetic oligonucleotide
uucaccaacaggaacuaug

SEQ ID NO: 2772 - RNA, 19 nt, Artificial Sequence
  Synthetic oligonucleotide
ucaccaacaggaacuauga

SEQ ID NO: 2773 - RNA, 19 nt, Artificial Sequence
  Synthetic oligonucleotide
caccaacaggaacuaugac

SEQ ID NO: 2774 - RNA, 19 nt, Artificial Sequence
  Synthetic oligonucleotide
accaacaggaacuaugacc

SEQ ID NO: 2775 - RNA, 19 nt, Artificial Sequence
  Synthetic oligonucleotide
ccaacaggaacuaugaccu

SEQ ID NO: 2776 - RNA, 19 nt, Artificial Sequence
  Synthetic oligonucleotide
caacaggaacuaugaccuc

SEQ ID NO: 2777 - RNA, 19 nt, Artificial Sequence
  Synthetic oligonucleotide
aacaggaacuaugaccucg

SEQ ID NO: 2778 - RNA, 19 nt, Artificial Sequence
  Synthetic oligonucleotide
acaggaacuaugaccucga

SEQ ID NO: 2779 - RNA, 19 nt, Artificial Sequence
  Synthetic oligonucleotide
caggaacuaugaccucgac

SEQ ID NO: 2780 - RNA, 19 nt, Artificial Sequence
  Synthetic oligonucleotide
aggaacuaugaccucgacu

SEQ ID NO: 2781 - RNA, 19 nt, Artificial Sequence
  Synthetic oligonucleotide
ggaacuaugaccucgacua

SEQ ID NO: 2782 - RNA, 19 nt, Artificial Sequence
  Synthetic oligonucleotide
gaacuaugaccucgacuac

SEQ ID NO: 2783 - RNA, 19 nt, Artificial Sequence
  Synthetic oligonucleotide
aacuaugaccucgacuacg

SEQ ID NO: 2784 - RNA, 19 nt, Artificial Sequence
  Synthetic oligonucleotide
acuaugaccucgacuacga

SEQ ID NO: 2785 - RNA, 19 nt, Artificial Sequence
  Synthetic oligonucleotide
cuaugaccucgacuacgac

SEQ ID NO: 2786 - RNA, 19 nt, Artificial Sequence
  Synthetic oligonucleotide
uaugaccucgacuacgacu

SEQ ID NO: 2787 - RNA, 19 nt, Artificial Sequence
  Synthetic oligonucleotide
cgaggauaucuggaagaaa

SEQ ID NO: 2788 - RNA, 19 nt, Artificial Sequence
  Synthetic oligonucleotide
gaggauaucuggaagaaau

SEQ ID NO: 2789 - RNA, 19 nt, Artificial Sequence
  Synthetic oligonucleotide
aggauaucuggaagaaauu

SEQ ID NO: 2790 - RNA, 19 nt, Artificial Sequence
  Synthetic oligonucleotide
ggauaucuggaagaaauuc

SEQ ID NO: 2791 - RNA, 19 nt, Artificial Sequence
  Synthetic oligonucleotide
gauaucuggaagaaauucg

SEQ ID NO: 2792 - RNA, 19 nt, Artificial Sequence
  Synthetic oligonucleotide
auaucuggaagaaauucga

SEQ ID NO: 2793 - RNA, 19 nt, Artificial Sequence
  Synthetic oligonucleotide
uaucuggaagaaauucgag

SEQ ID NO: 2794 - RNA, 19 nt, Artificial Sequence
  Synthetic oligonucleotide
aucuggaagaaauucgagc

SEQ ID NO: 2795 - RNA, 19 nt, Artificial Sequence
  Synthetic oligonucleotide
ucuggaagaaauucgagcu

SEQ ID NO: 2796 - RNA, 19 nt, Artificial Sequence
  Synthetic oligonucleotide
cuggaagaaauucgagcug

SEQ ID NO: 2797 - RNA, 19 nt, Artificial Sequence
  Synthetic oligonucleotide
uggaagaaauucgagcugc

SEQ ID NO: 2798 - RNA, 19 nt, Artificial Sequence
  Synthetic oligonucleotide
uagccgccgcuccgggcuc

SEQ ID NO: 2799 - RNA, 19 nt, Artificial Sequence
  Synthetic oligonucleotide
agccgccgcuccgggcucu

SEQ ID NO: 2800 - RNA, 19 nt, Artificial Sequence
  Synthetic oligonucleotide
gccgccgcuccgggcucug

SEQ ID NO: 2801 - RNA, 19 nt, Artificial Sequence
  Synthetic oligonucleotide
ccgccgcuccgggcucugc

SEQ ID NO: 2802 - RNA, 19 nt, Artificial Sequence
  Synthetic oligonucleotide
cgccgcuccgggcucugcu

SEQ ID NO: 2803 - RNA, 19 nt, Artificial Sequence
  Synthetic oligonucleotide
gggaggagacauggugaac

SEQ ID NO: 2804 - RNA, 19 nt, Artificial Sequence
  Synthetic oligonucleotide
ggaggagacauggugaacc

SEQ ID NO: 2805 - RNA, 19 nt, Artificial Sequence
  Synthetic oligonucleotide
gaggagacauggugaacca

SEQ ID NO: 2806 - RNA, 19 nt, Artificial Sequence
  Synthetic oligonucleotide
aggagacauggugaaccag

SEQ ID NO: 2807 - RNA, 19 nt, Artificial Sequence
  Synthetic oligonucleotide
ggagacauggugaaccaga

SEQ ID NO: 2808 - RNA, 19 nt, Artificial Sequence
  Synthetic oligonucleotide
ggacgacgagaccuucauc

SEQ ID NO: 2809 - RNA, 19 nt, Artificial Sequence
  Synthetic oligonucleotide
gacgacgagaccuucauca

SEQ ID NO: 2810 - RNA, 19 nt, Artificial Sequence
  Synthetic oligonucleotide
aaacaucaucauccaggac

SEQ ID NO: 2811 - RNA, 19 nt, Artificial Sequence
  Synthetic oligonucleotide
aacaucaucauccaggacu

SEQ ID NO: 2812 - RNA, 19 nt, Artificial Sequence
  Synthetic oligonucleotide
acaucaucauccaggacug

SEQ ID NO: 2813 - RNA, 19 nt, Artificial Sequence
  Synthetic oligonucleotide
caucaucauccaggacugu

SEQ ID NO: 2814 - RNA, 19 nt, Artificial Sequence
  Synthetic oligonucleotide
aucaucauccaggacugua

SEQ ID NO: 2815 - RNA, 19 nt, Artificial Sequence
  Synthetic oligonucleotide
ucaucauccaggacuguau

SEQ ID NO: 2816 - RNA, 19 nt, Artificial Sequence
  Synthetic oligonucleotide
caucauccaggacuguaug

SEQ ID NO: 2817 - RNA, 19 nt, Artificial Sequence
  Synthetic oligonucleotide
aucauccaggacuguaugu

SEQ ID NO: 2818 - RNA, 19 nt, Artificial Sequence
  Synthetic oligonucleotide
ucauccaggacuguaugug

SEQ ID NO: 2819 - RNA, 19 nt, Artificial Sequence
  Synthetic oligonucleotide
cauccaggacuguaugugg

SEQ ID NO: 2820 - RNA, 19 nt, Artificial Sequence
  Synthetic oligonucleotide
auccaggacuguaugugga

SEQ ID NO: 2821 - RNA, 19 nt, Artificial Sequence
  Synthetic oligonucleotide
uccaggacuguauguggag

SEQ ID NO: 2822 - RNA, 19 nt, Artificial Sequence
  Synthetic oligonucleotide
ccaggacuguauguggagc

SEQ ID NO: 2823 - RNA, 19 nt, Artificial Sequence
  Synthetic oligonucleotide
caggacuguauguggagcg

SEQ ID NO: 2824 - RNA, 19 nt, Artificial Sequence
  Synthetic oligonucleotide
agagaagcuggccuccuac

SEQ ID NO: 2825 - RNA, 19 nt, Artificial Sequence
  Synthetic oligonucleotide
gagaagcuggccuccuacc

SEQ ID NO: 2826 - RNA, 19 nt, Artificial Sequence
  Synthetic oligonucleotide
agaagcuggccuccuacca

SEQ ID NO: 2827 - RNA, 19 nt, Artificial Sequence
  Synthetic oligonucleotide
gaagcuggccuccuaccag

SEQ ID NO: 2828 - RNA, 19 nt, Artificial Sequence
  Synthetic oligonucleotide
aagcuggccuccuaccagg

SEQ ID NO: 2829 - RNA, 19 nt, Artificial Sequence
  Synthetic oligonucleotide
agcuggccuccuaccaggc

SEQ ID NO: 2830 - RNA, 19 nt, Artificial Sequence
  Synthetic oligonucleotide
gcuggccuccuaccaggcu

SEQ ID NO: 2831 - RNA, 19 nt, Artificial Sequence
  Synthetic oligonucleotide
cuggccuccuaccaggcug

SEQ ID NO: 2832 - RNA, 19 nt, Artificial Sequence
  Synthetic oligonucleotide
uggccuccuaccaggcugc

SEQ ID NO: 2833 - RNA, 19 nt, Artificial Sequence
  Synthetic oligonucleotide
ggccuccuaccaggcugcg

SEQ ID NO: 2834 - RNA, 19 nt, Artificial Sequence
  Synthetic oligonucleotide
gccuccuaccaggcugcgc

SEQ ID NO: 2835 - RNA, 19 nt, Artificial Sequence
  Synthetic oligonucleotide
ccuccuaccaggcugcgcg

SEQ ID NO: 2836 - RNA, 19 nt, Artificial Sequence
  Synthetic oligonucleotide
cuccuaccaggcugcgcgc

SEQ ID NO: 2837 - RNA, 19 nt, Artificial Sequence
  Synthetic oligonucleotide
uccuaccaggcugcgcgca

SEQ ID NO: 2838 - RNA, 19 nt, Artificial Sequence
  Synthetic oligonucleotide
ccuaccaggcugcgcgcaa

SEQ ID NO: 2839 - RNA, 19 nt, Artificial Sequence
  Synthetic oligonucleotide
cuaccaggcugcgcgcaaa

SEQ ID NO: 2840 - RNA, 19 nt, Artificial Sequence
  Synthetic oligonucleotide
uaccaggcugcgcgcaaag

SEQ ID NO: 2841 - RNA, 19 nt, Artificial Sequence
  Synthetic oligonucleotide
accaggcugcgcgcaaaga

SEQ ID NO: 2842 - RNA, 19 nt, Artificial Sequence
  Synthetic oligonucleotide
ccaggcugcgcgcaaagac

SEQ ID NO: 2843 - RNA, 19 nt, Artificial Sequence
  Synthetic oligonucleotide
caggcugcgcgcaaagaca

SEQ ID NO: 2844 - RNA, 19 nt, Artificial Sequence
  Synthetic oligonucleotide
aggcugcgcgcaaagacag

SEQ ID NO: 2845 - RNA, 19 nt, Artificial Sequence
  Synthetic oligonucleotide
ccacagcgucugcuccacc

SEQ ID NO: 2846 - RNA, 19 nt, Artificial Sequence
  Synthetic oligonucleotide
cacagcgucugcuccaccu

SEQ ID NO: 2847 - RNA, 19 nt, Artificial Sequence
  Synthetic oligonucleotide
acagcgucugcuccaccuc

SEQ ID NO: 2848 - RNA, 19 nt, Artificial Sequence
  Synthetic oligonucleotide
cagcgucugcuccaccucc

SEQ ID NO: 2849 - RNA, 19 nt, Artificial Sequence
  Synthetic oligonucleotide
agcgucugcuccaccucca

SEQ ID NO: 2850 - RNA, 19 nt, Artificial Sequence
  Synthetic oligonucleotide
gcgucugcuccaccuccag

SEQ ID NO: 2851 - RNA, 19 nt, Artificial Sequence
  Synthetic oligonucleotide
ucucaacgacagcagcucg

SEQ ID NO: 2852 - RNA, 19 nt, Artificial Sequence
  Synthetic oligonucleotide
cucaacgacagcagcucgc

SEQ ID NO: 2853 - RNA, 19 nt, Artificial Sequence
  Synthetic oligonucleotide
ucaacgacagcagcucgcc

SEQ ID NO: 2854 - RNA, 19 nt, Artificial Sequence
  Synthetic oligonucleotide
caacgacagcagcucgccc

SEQ ID NO: 2855 - RNA, 19 nt, Artificial Sequence
  Synthetic oligonucleotide
aacgacagcagcucgccca

SEQ ID NO: 2856 - RNA, 19 nt, Artificial Sequence
  Synthetic oligonucleotide
ccaugaggagacaccgccc

SEQ ID NO: 2857 - RNA, 19 nt, Artificial Sequence
  Synthetic oligonucleotide
caugaggagacaccgccca

SEQ ID NO: 2858 - RNA, 19 nt, Artificial Sequence
  Synthetic oligonucleotide
augaggagacaccgcccac

SEQ ID NO: 2859 - RNA, 19 nt, Artificial Sequence
  Synthetic oligonucleotide
ugaggagacaccgcccacc

SEQ ID NO: 2860 - RNA, 19 nt, Artificial Sequence
  Synthetic oligonucleotide
gaggagacaccgcccacca

SEQ ID NO: 2861 - RNA, 19 nt, Artificial Sequence
  Synthetic oligonucleotide
aggagacaccgcccaccac

SEQ ID NO: 2862 - RNA, 19 nt, Artificial Sequence
  Synthetic oligonucleotide
ggagacaccgcccaccacc

SEQ ID NO: 2863 - RNA, 19 nt, Artificial Sequence
  Synthetic oligonucleotide
gagacaccgcccaccacca

SEQ ID NO: 2864 - RNA, 19 nt, Artificial Sequence
  Synthetic oligonucleotide
agacaccgcccaccaccag

SEQ ID NO: 2865 - RNA, 19 nt, Artificial Sequence
  Synthetic oligonucleotide
gacaccgcccaccaccagc

SEQ ID NO: 2866 - RNA, 19 nt, Artificial Sequence
  Synthetic oligonucleotide
acaccgcccaccaccagca

SEQ ID NO: 2867 - RNA, 19 nt, Artificial Sequence
  Synthetic oligonucleotide
caccgcccaccaccagcag

SEQ ID NO: 2868 - RNA, 19 nt, Artificial Sequence
  Synthetic oligonucleotide
accgcccaccaccagcagc

SEQ ID NO: 2869 - RNA, 19 nt, Artificial Sequence
  Synthetic oligonucleotide
ccgcccaccaccagcagcg

SEQ ID NO: 2870 - RNA, 19 nt, Artificial Sequence
  Synthetic oligonucleotide
cgcccaccaccagcagcga

SEQ ID NO: 2871 - RNA, 19 nt, Artificial Sequence
  Synthetic oligonucleotide
gcccaccaccagcagcgac

SEQ ID NO: 2872 - RNA, 19 nt, Artificial Sequence
  Synthetic oligonucleotide
cccaccaccagcagcgacu

SEQ ID NO: 2873 - RNA, 19 nt, Artificial Sequence
  Synthetic oligonucleotide
ccaccaccagcagcgacuc

SEQ ID NO: 2874 - RNA, 19 nt, Artificial Sequence
  Synthetic oligonucleotide
caccaccagcagcgacucu

SEQ ID NO: 2875 - RNA, 19 nt, Artificial Sequence
  Synthetic oligonucleotide
accaccagcagcgacucug

SEQ ID NO: 2876 - RNA, 19 nt, Artificial Sequence
  Synthetic oligonucleotide
acaagaagaugaggaagaa

SEQ ID NO: 2877 - RNA, 19 nt, Artificial Sequence
  Synthetic oligonucleotide
caagaagaugaggaagaaa

SEQ ID NO: 2878 - RNA, 19 nt, Artificial Sequence
  Synthetic oligonucleotide
ggaggccacagcaaaccuc

SEQ ID NO: 2879 - RNA, 19 nt, Artificial Sequence
  Synthetic oligonucleotide
ucacagcccacugguccuc

SEQ ID NO: 2880 - RNA, 19 nt, Artificial Sequence
  Synthetic oligonucleotide
cacagcccacugguccuca

SEQ ID NO: 2881 - RNA, 19 nt, Artificial Sequence
  Synthetic oligonucleotide
acagcccacugguccucaa

SEQ ID NO: 2882 - RNA, 19 nt, Artificial Sequence
  Synthetic oligonucleotide
cagcccacugguccucaag

SEQ ID NO: 2883 - RNA, 19 nt, Artificial Sequence
  Synthetic oligonucleotide
agcccacugguccucaaga

SEQ ID NO: 2884 - RNA, 19 nt, Artificial Sequence
  Synthetic oligonucleotide
gcccacugguccucaagag

SEQ ID NO: 2885 - RNA, 19 nt, Artificial Sequence
  Synthetic oligonucleotide
cccacugguccucaagagg

SEQ ID NO: 2886 - RNA, 19 nt, Artificial Sequence
  Synthetic oligonucleotide
ccacugguccucaagaggu

SEQ ID NO: 2887 - RNA, 19 nt, Artificial Sequence
  Synthetic oligonucleotide
cacugguccucaagaggug

SEQ ID NO: 2888 - RNA, 19 nt, Artificial Sequence
  Synthetic oligonucleotide
acugguccucaagaggugc

SEQ ID NO: 2889 - RNA, 19 nt, Artificial Sequence
  Synthetic oligonucleotide
cugguccucaagaggugcc

SEQ ID NO: 2890 - RNA, 19 nt, Artificial Sequence
  Synthetic oligonucleotide
ugguccucaagaggugcca

SEQ ID NO: 2891 - RNA, 19 nt, Artificial Sequence
  Synthetic oligonucleotide
gguccucaagaggugccac

SEQ ID NO: 2892 - RNA, 19 nt, Artificial Sequence
  Synthetic oligonucleotide
guccucaagaggugccacg

SEQ ID NO: 2893 - RNA, 19 nt, Artificial Sequence
  Synthetic oligonucleotide
uccucaagaggugccacgu

SEQ ID NO: 2894 - RNA, 19 nt, Artificial Sequence
  Synthetic oligonucleotide
ccucaagaggugccacguc

SEQ ID NO: 2895 - RNA, 19 nt, Artificial Sequence
  Synthetic oligonucleotide
gagcuuuuuugcccugcgu

SEQ ID NO: 2896 - RNA, 19 nt, Artificial Sequence
  Synthetic oligonucleotide
agcuuuuuugcccugcgug

SEQ ID NO: 2897 - RNA, 19 nt, Artificial Sequence
  Synthetic oligonucleotide
gcuuuuuugcccugcguga

SEQ ID NO: 2898 - RNA, 19 nt, Artificial Sequence
  Synthetic oligonucleotide
cuuuuuugcccugcgugac

SEQ ID NO: 2899 - RNA, 19 nt, Artificial Sequence
  Synthetic oligonucleotide
uuuuuugcccugcgugacc

SEQ ID NO: 2900 - RNA, 19 nt, Artificial Sequence
  Synthetic oligonucleotide
uuuuugcccugcgugacca

SEQ ID NO: 2901 - RNA, 19 nt, Artificial Sequence
  Synthetic oligonucleotide
uuuugcccugcgugaccag

SEQ ID NO: 2902 - RNA, 19 nt, Artificial Sequence
  Synthetic oligonucleotide
uuugcccugcgugaccaga

SEQ ID NO: 2903 - RNA, 19 nt, Artificial Sequence
  Synthetic oligonucleotide
uugcccugcgugaccagau

SEQ ID NO: 2904 - RNA, 19 nt, Artificial Sequence
  Synthetic oligonucleotide
ugcccugcgugaccagauc

SEQ ID NO: 2905 - RNA, 19 nt, Artificial Sequence
  Synthetic oligonucleotide
gcccugcgugaccagaucc

SEQ ID NO: 2906 - RNA, 19 nt, Artificial Sequence
  Synthetic oligonucleotide
cggaaacgacgagaacagu

SEQ ID NO: 2907 - RNA, 19 nt, Artificial Sequence
  Synthetic oligonucleotide
ggaaacgacgagaacaguu

SEQ ID NO: 2908 - RNA, 19 nt, Artificial Sequence
  Synthetic oligonucleotide
cuuuaacagauuuguauuu

SEQ ID NO: 2909 - RNA, 19 nt, Artificial Sequence
  Synthetic oligonucleotide
uuuaacagauuuguauuua

SEQ ID NO: 2910 - RNA, 19 nt, Artificial Sequence
  Synthetic oligonucleotide
uaaauguaaauaacuuuaa

SEQ ID NO: 2911 - RNA, 19 nt, Artificial Sequence
  Synthetic oligonucleotide
aaauguaaauaacuuuaau

SEQ ID NO: 2912 - RNA, 19 nt, Artificial Sequence
  Synthetic oligonucleotide
aauguaaauaacuuuaaua

SEQ ID NO: 2913 - RNA, 19 nt, Artificial Sequence
  Synthetic oligonucleotide
auguaaauaacuuuaauaa

SEQ ID NO: 2914 - RNA, 19 nt, Artificial Sequence
  Synthetic oligonucleotide
uguaaauaacuuuaauaaa

SEQ ID NO: 2915 - RNA, 19 nt, Artificial Sequence
  Synthetic oligonucleotide
guaaauaacuuuaauaaaa

SEQ ID NO: 2916 - RNA, 19 nt, Artificial Sequence
  Synthetic oligonucleotide
uaaauaacuuuaauaaaac

SEQ ID NO: 2917 - RNA, 19 nt, Artificial Sequence
  Synthetic oligonucleotide
aaauaacuuuaauaaaacg

SEQ ID NO: 2918 - RNA, 19 nt, Artificial Sequence
  Synthetic oligonucleotide
aauaacuuuaauaaaacgu

SEQ ID NO: 2919 - RNA, 19 nt, Artificial Sequence
  Synthetic oligonucleotide
auaacuuuaauaaaacguu

SEQ ID NO: 2920 - RNA, 19 nt, Artificial Sequence
  Synthetic oligonucleotide
uaacuuuaauaaaacguuu

SEQ ID NO: 2921 - RNA, 19 nt, Artificial Sequence
  Synthetic oligonucleotide
aacuuuaauaaaacguuua

SEQ ID NO: 2922 - RNA, 19 nt, Artificial Sequence
  Synthetic oligonucleotide
acuuuaauaaaacguuuau

SEQ ID NO: 2923 - RNA, 19 nt, Artificial Sequence
  Synthetic oligonucleotide
cuuuuuaaaguugauuuuu

SEQ ID NO: 2924 - RNA, 19 nt, Artificial Sequence
  Synthetic oligonucleotide
uuuuuaaaguugauuuuuu

SEQ ID NO: 2925 - RNA, 19 nt, Artificial Sequence
  Synthetic oligonucleotide
uuuuaaaguugauuuuuuu

SEQ ID NO: 2926 - RNA, 19 nt, Artificial Sequence
  Synthetic oligonucleotide
uuuaaaguugauuuuuuuc

SEQ ID NO: 2927 - RNA, 19 nt, Artificial Sequence
  Synthetic oligonucleotide
uuaaaguugauuuuuuucu

SEQ ID NO: 2928 - RNA, 19 nt, Artificial Sequence
  Synthetic oligonucleotide
uaaaguugauuuuuuucua

SEQ ID NO: 2929 - RNA, 19 nt, Artificial Sequence
  Synthetic oligonucleotide
aaaguugauuuuuuucuau

SEQ ID NO: 2930 - RNA, 19 nt, Artificial Sequence
  Synthetic oligonucleotide
aaguugauuuuuuucuauu

SEQ ID NO: 2931 - RNA, 19 nt, Artificial Sequence
  Synthetic oligonucleotide
aguugauuuuuuucuauug

SEQ ID NO: 2932 - RNA, 19 nt, Artificial Sequence
  Synthetic oligonucleotide
guugauuuuuuucuauugu

SEQ ID NO: 2933 - RNA, 19 nt, Artificial Sequence
  Synthetic oligonucleotide
uugauuuuuuucuauuguu

SEQ ID NO: 2934 - RNA, 19 nt, Artificial Sequence
  Synthetic oligonucleotide
ugauuuuuuucuauuguuu

SEQ ID NO: 2935 - RNA, 19 nt, Artificial Sequence
  Synthetic oligonucleotide
gauuuuuuucuauuguuuu

SEQ ID NO: 2936 - RNA, 19 nt, Artificial Sequence
  Synthetic oligonucleotide
auuuuuuucuauuguuuuu

SEQ ID NO: 2937 - RNA, 19 nt, Artificial Sequence
  Synthetic oligonucleotide
uuuuuuucuauuguuuuua

SEQ ID NO: 2938 - RNA, 19 nt, Artificial Sequence
  Synthetic oligonucleotide
uuuuuucuauuguuuuuag

SEQ ID NO: 2939 - RNA, 19 nt, Artificial Sequence
  Synthetic oligonucleotide
uuuuucuauuguuuuuaga

SEQ ID NO: 2940 - RNA, 19 nt, Artificial Sequence
  Synthetic oligonucleotide
uuuucuauuguuuuuagaa

SEQ ID NO: 2941 - RNA, 19 nt, Artificial Sequence
  Synthetic oligonucleotide
uuucuauuguuuuuagaaa

SEQ ID NO: 2942 - RNA, 19 nt, Artificial Sequence
  Synthetic oligonucleotide
uucuauuguuuuuagaaaa

SEQ ID NO: 2943 - RNA, 19 nt, Artificial Sequence
  Synthetic oligonucleotide
ucuauuguuuuuagaaaaa

SEQ ID NO: 2944 - RNA, 19 nt, Artificial Sequence
  Synthetic oligonucleotide
cucgagaagggcagggcuu

SEQ ID NO: 2945 - RNA, 19 nt, Artificial Sequence
  Synthetic oligonucleotide
gggcuuuaucuaacucgcu

SEQ ID NO: 2946 - RNA, 19 nt, Artificial Sequence
  Synthetic oligonucleotide
aacccuugccgcauccacg

SEQ ID NO: 2947 - RNA, 19 nt, Artificial Sequence
  Synthetic oligonucleotide
uugccgcauccacgaaacu

SEQ ID NO: 2948 - RNA, 19 nt, Artificial Sequence
  Synthetic oligonucleotide
cauccacgaaacuuugccc

SEQ ID NO: 2949 - RNA, 19 nt, Artificial Sequence
  Synthetic oligonucleotide
gggcgggcacuuugcacug

SEQ ID NO: 2950 - RNA, 19 nt, Artificial Sequence
  Synthetic oligonucleotide
gcacuuugcacuggaacuu

SEQ ID NO: 2951 - RNA, 19 nt, Artificial Sequence
  Synthetic oligonucleotide
cacuggaacuuacaacacc

SEQ ID NO: 2952 - RNA, 19 nt, Artificial Sequence
  Synthetic oligonucleotide
uugcagcugcuuagacgcu

SEQ ID NO: 2953 - RNA, 19 nt, Artificial Sequence
  Synthetic oligonucleotide
cugcuuagacgcuggauuu

SEQ ID NO: 2954 - RNA, 19 nt, Artificial Sequence
  Synthetic oligonucleotide
gacgcuggauuuuuuucgg

SEQ ID NO: 2955 - RNA, 19 nt, Artificial Sequence
  Synthetic oligonucleotide
uggauuuuuuucggguagu

SEQ ID NO: 2956 - RNA, 19 nt, Artificial Sequence
  Synthetic oligonucleotide
uucggguaguggaaaacca

SEQ ID NO: 2957 - RNA, 19 nt, Artificial Sequence
  Synthetic oligonucleotide
cccucaacguuagcuucac

SEQ ID NO: 2958 - RNA, 19 nt, Artificial Sequence
  Synthetic oligonucleotide
acguuagcuucaccaacag

SEQ ID NO: 2959 - RNA, 19 nt, Artificial Sequence
  Synthetic oligonucleotide
acgacucggugcagccgua

SEQ ID NO: 2960 - RNA, 19 nt, Artificial Sequence
  Synthetic oligonucleotide
gugcagccguauuucuacu

SEQ ID NO: 2961 - RNA, 19 nt, Artificial Sequence
  Synthetic oligonucleotide
aggaggagaacuucuacca

SEQ ID NO: 2962 - RNA, 19 nt, Artificial Sequence
  Synthetic oligonucleotide
cagcgaggauaucuggaag

SEQ ID NO: 2963 - RNA, 19 nt, Artificial Sequence
  Synthetic oligonucleotide
uacguugcggucacacccu

SEQ ID NO: 2964 - RNA, 19 nt, Artificial Sequence
  Synthetic oligonucleotide
agacauggugaaccagagu

SEQ ID NO: 2965 - RNA, 19 nt, Artificial Sequence
  Synthetic oligonucleotide
acccggacgacgagaccuu

SEQ ID NO: 2966 - RNA, 19 nt, Artificial Sequence
  Synthetic oligonucleotide
acgagaccuucaucaaaaa

SEQ ID NO: 2967 - RNA, 19 nt, Artificial Sequence
  Synthetic oligonucleotide
ucaaaaacaucaucaucca

SEQ ID NO: 2968 - RNA, 19 nt, Artificial Sequence
  Synthetic oligonucleotide
caggacuguauguggagcg

SEQ ID NO: 2969 - RNA, 19 nt, Artificial Sequence
  Synthetic oligonucleotide
gucugcuccaccuccagcu

SEQ ID NO: 2970 - RNA, 19 nt, Artificial Sequence
  Synthetic oligonucleotide
ccaccuccagcuuguaccu

SEQ ID NO: 2971 - RNA, 19 nt, Artificial Sequence
  Synthetic oligonucleotide
uccagcuuguaccugcagg

SEQ ID NO: 2972 - RNA, 19 nt, Artificial Sequence
  Synthetic oligonucleotide
ccaaguccugcgccucgca

SEQ ID NO: 2973 - RNA, 19 nt, Artificial Sequence
  Synthetic oligonucleotide
cagcagcgacucugaggag

SEQ ID NO: 2974 - RNA, 19 nt, Artificial Sequence
  Synthetic oligonucleotide
cgacucugaggaggaacaa

SEQ ID NO: 2975 - RNA, 19 nt, Artificial Sequence
  Synthetic oligonucleotide
cugaggaggaacaagaaga

SEQ ID NO: 2976 - RNA, 19 nt, Artificial Sequence
  Synthetic oligonucleotide
ggaacaagaagaugaggaa

SEQ ID NO: 2977 - RNA, 19 nt, Artificial Sequence
  Synthetic oligonucleotide
agaagaugaggaagaaauc

SEQ ID NO: 2978 - RNA, 19 nt, Artificial Sequence
  Synthetic oligonucleotide
ugaggaagaaaucgauguu

SEQ ID NO: 2979 - RNA, 19 nt, Artificial Sequence
  Synthetic oligonucleotide
agaaaucgauguuguuucu

SEQ ID NO: 2980 - RNA, 19 nt, Artificial Sequence
  Synthetic oligonucleotide
cgauguuguuucuguggaa

SEQ ID NO: 2981 - RNA, 19 nt, Artificial Sequence
  Synthetic oligonucleotide
aagaggcaggcuccuggca

SEQ ID NO: 2982 - RNA, 19 nt, Artificial Sequence
  Synthetic oligonucleotide
gcaggcuccuggcaaaagg

SEQ ID NO: 2983 - RNA, 19 nt, Artificial Sequence
  Synthetic oligonucleotide
cuccuggcaaaaggucaga

SEQ ID NO: 2984 - RNA, 19 nt, Artificial Sequence
  Synthetic oligonucleotide
ggcaaaaggucagagucug

SEQ ID NO: 2985 - RNA, 19 nt, Artificial Sequence
  Synthetic oligonucleotide
aaggucagagucuggauca

SEQ ID NO: 2986 - RNA, 19 nt, Artificial Sequence
  Synthetic oligonucleotide
cagcaaaccuccucacagc

SEQ ID NO: 2987 - RNA, 19 nt, Artificial Sequence
  Synthetic oligonucleotide
cuccucacagcccacuggu

SEQ ID NO: 2988 - RNA, 19 nt, Artificial Sequence
  Synthetic oligonucleotide
cucccuccacucggaagga

SEQ ID NO: 2989 - RNA, 19 nt, Artificial Sequence
  Synthetic oligonucleotide
cacucggaaggacuauccu

SEQ ID NO: 2990 - RNA, 19 nt, Artificial Sequence
  Synthetic oligonucleotide
cuauccugcugccaagagg

SEQ ID NO: 2991 - RNA, 19 nt, Artificial Sequence
  Synthetic oligonucleotide
cugcugccaagagggucaa

SEQ ID NO: 2992 - RNA, 19 nt, Artificial Sequence
  Synthetic oligonucleotide
gccaagagggucaaguugg

SEQ ID NO: 2993 - RNA, 19 nt, Artificial Sequence
  Synthetic oligonucleotide
gagggucaaguuggacagu

SEQ ID NO: 2994 - RNA, 19 nt, Artificial Sequence
  Synthetic oligonucleotide
ucaaguuggacagugucag

SEQ ID NO: 2995 - RNA, 19 nt, Artificial Sequence
  Synthetic oligonucleotide
uuggacagugucagagucc

SEQ ID NO: 2996 - RNA, 19 nt, Artificial Sequence
  Synthetic oligonucleotide
gucagaguccugagacaga

SEQ ID NO: 2997 - RNA, 19 nt, Artificial Sequence
  Synthetic oligonucleotide
cugagacagaucagcaaca

SEQ ID NO: 2998 - RNA, 19 nt, Artificial Sequence
  Synthetic oligonucleotide
cagaucagcaacaaccgaa

SEQ ID NO: 2999 - RNA, 19 nt, Artificial Sequence
  Synthetic oligonucleotide
guccucggacaccgaggag

SEQ ID NO: 3000 - RNA, 19 nt, Artificial Sequence
  Synthetic oligonucleotide
cggacaccgaggagaaugu

SEQ ID NO: 3001 - RNA, 19 nt, Artificial Sequence
  Synthetic oligonucleotide
gccagaggaggaacgagcu

SEQ ID NO: 3002 - RNA, 19 nt, Artificial Sequence
  Synthetic oligonucleotide
ggaggaacgagcuaaaacg

SEQ ID NO: 3003 - RNA, 19 nt, Artificial Sequence
  Synthetic oligonucleotide
aacgagcuaaaacggagcu

SEQ ID NO: 3004 - RNA, 19 nt, Artificial Sequence
  Synthetic oligonucleotide
cuaaaacggagcuuuuuug

SEQ ID NO: 3005 - RNA, 19 nt, Artificial Sequence
  Synthetic oligonucleotide
acggagcuuuuuugcccug

SEQ ID NO: 3006 - RNA, 19 nt, Artificial Sequence
  Synthetic oligonucleotide
gugaccagaucccggaguu

SEQ ID NO: 3007 - RNA, 19 nt, Artificial Sequence
  Synthetic oligonucleotide
cagaucccggaguuggaaa

SEQ ID NO: 3008 - RNA, 19 nt, Artificial Sequence
  Synthetic oligonucleotide
cccggaguuggaaaacaau

SEQ ID NO: 3009 - RNA, 19 nt, Artificial Sequence
  Synthetic oligonucleotide
caagguaguuauccuuaaa

SEQ ID NO: 3010 - RNA, 19 nt, Artificial Sequence
  Synthetic oligonucleotide
uaguuauccuuaaaaaagc

SEQ ID NO: 3011 - RNA, 19 nt, Artificial Sequence
  Synthetic oligonucleotide
auccuuaaaaaagccacag

SEQ ID NO: 3012 - RNA, 19 nt, Artificial Sequence
  Synthetic oligonucleotide
uaaaaaagccacagcauac

SEQ ID NO: 3013 - RNA, 19 nt, Artificial Sequence
  Synthetic oligonucleotide
aagccacagcauacauccu

SEQ ID NO: 3014 - RNA, 19 nt, Artificial Sequence
  Synthetic oligonucleotide
cagcauacauccuguccgu

SEQ ID NO: 3015 - RNA, 19 nt, Artificial Sequence
  Synthetic oligonucleotide
auccuguccguccaagcag

SEQ ID NO: 3016 - RNA, 19 nt, Artificial Sequence
  Synthetic oligonucleotide
guccguccaagcagaggag

SEQ ID NO: 3017 - RNA, 19 nt, Artificial Sequence
  Synthetic oligonucleotide
aagcagaggagcaaaagcu

SEQ ID NO: 3018 - RNA, 19 nt, Artificial Sequence
  Synthetic oligonucleotide
ggagcaaaagcucauuucu

SEQ ID NO: 3019 - RNA, 19 nt, Artificial Sequence
  Synthetic oligonucleotide
aaaagcucauuucugaaga

SEQ ID NO: 3020 - RNA, 19 nt, Artificial Sequence
  Synthetic oligonucleotide
ucauuucugaagaggacuu

SEQ ID NO: 3021 - RNA, 19 nt, Artificial Sequence
  Synthetic oligonucleotide
cugaagaggacuuguugcg

SEQ ID NO: 3022 - RNA, 19 nt, Artificial Sequence
  Synthetic oligonucleotide
gaggacuuguugcggaaac

SEQ ID NO: 3023 - RNA, 19 nt, Artificial Sequence
  Synthetic oligonucleotide
cuuguugcggaaacgacga

SEQ ID NO: 3024 - RNA, 19 nt, Artificial Sequence
  Synthetic oligonucleotide
ugcggaaacgacgagaaca

SEQ ID NO: 3025 - RNA, 19 nt, Artificial Sequence
  Synthetic oligonucleotide
acaaacuugaacagcuacg

SEQ ID NO: 3026 - RNA, 19 nt, Artificial Sequence
  Synthetic oligonucleotide
uugaacagcuacggaacuc

SEQ ID NO: 3027 - RNA, 19 nt, Artificial Sequence
  Synthetic oligonucleotide
cagcuacggaacucuugug

SEQ ID NO: 3028 - RNA, 19 nt, Artificial Sequence
  Synthetic oligonucleotide
ggaacucuugugcguaagg

SEQ ID NO: 3029 - RNA, 19 nt, Artificial Sequence
  Synthetic oligonucleotide
cuugugcguaaggaaaagu

SEQ ID NO: 3030 - RNA, 19 nt, Artificial Sequence
  Synthetic oligonucleotide
gcguaaggaaaaguaagga

SEQ ID NO: 3031 - RNA, 19 nt, Artificial Sequence
  Synthetic oligonucleotide
aaguaaggaaaacgauucc

SEQ ID NO: 3032 - RNA, 19 nt, Artificial Sequence
  Synthetic oligonucleotide
aggaaaacgauuccuucua

SEQ ID NO: 3033 - RNA, 19 nt, Artificial Sequence
  Synthetic oligonucleotide
aacgauuccuucuaacaga

SEQ ID NO: 3034 - RNA, 19 nt, Artificial Sequence
  Synthetic oligonucleotide
uccuucuaacagaaauguc

SEQ ID NO: 3035 - RNA, 19 nt, Artificial Sequence
  Synthetic oligonucleotide
aacagaaauguccugagca

SEQ ID NO: 3036 - RNA, 19 nt, Artificial Sequence
  Synthetic oligonucleotide
guccugagcaaucaccuau

SEQ ID NO: 3037 - RNA, 19 nt, Artificial Sequence
  Synthetic oligonucleotide
agcaaucaccuaugaacuu

SEQ ID NO: 3038 - RNA, 19 nt, Artificial Sequence
  Synthetic oligonucleotide
caccuaugaacuuguuuca

SEQ ID NO: 3039 - RNA, 19 nt, Artificial Sequence
  Synthetic oligonucleotide
augaacuuguuucaaaugc

SEQ ID NO: 3040 - RNA, 19 nt, Artificial Sequence
  Synthetic oligonucleotide
uuguuucaaaugcaugauc

SEQ ID NO: 3041 - RNA, 19 nt, Artificial Sequence
  Synthetic oligonucleotide
ucaaaugcaugaucaaaug

SEQ ID NO: 3042 - RNA, 19 nt, Artificial Sequence
  Synthetic oligonucleotide
augaucaaaugcaaccuca

SEQ ID NO: 3043 - RNA, 19 nt, Artificial Sequence
  Synthetic oligonucleotide
caaaugcaaccucacaacc

SEQ ID NO: 3044 - RNA, 19 nt, Artificial Sequence
  Synthetic oligonucleotide
aaccucacaaccuuggcug

SEQ ID NO: 3045 - RNA, 19 nt, Artificial Sequence
  Synthetic oligonucleotide
cacaaccuuggcugagucu

SEQ ID NO: 3046 - RNA, 19 nt, Artificial Sequence
  Synthetic oligonucleotide
uuggcugagucuugagacu

SEQ ID NO: 3047 - RNA, 19 nt, Artificial Sequence
  Synthetic oligonucleotide
gagucuugagacugaaaga

SEQ ID NO: 3048 - RNA, 19 nt, Artificial Sequence
  Synthetic oligonucleotide
gagacugaaagauuuagcc

SEQ ID NO: 3049 - RNA, 19 nt, Artificial Sequence
  Synthetic oligonucleotide
ugaaagauuuagccauaau

SEQ ID NO: 3050 - RNA, 19 nt, Artificial Sequence
  Synthetic oligonucleotide
uagccauaauguaaacugc

SEQ ID NO: 3051 - RNA, 19 nt, Artificial Sequence
  Synthetic oligonucleotide
auguaaacugccucaaauu

SEQ ID NO: 3052 - RNA, 19 nt, Artificial Sequence
  Synthetic oligonucleotide
acugccucaaauuggacuu

SEQ ID NO: 3053 - RNA, 19 nt, Artificial Sequence
  Synthetic oligonucleotide
cucaaauuggacuuugggc

SEQ ID NO: 3054 - RNA, 19 nt, Artificial Sequence
  Synthetic oligonucleotide
uggacuuugggcauaaaag

SEQ ID NO: 3055 - RNA, 19 nt, Artificial Sequence
  Synthetic oligonucleotide
ugggcauaaaagaacuuuu

SEQ ID NO: 3056 - RNA, 19 nt, Artificial Sequence
  Synthetic oligonucleotide
auaaaagaacuuuuuuaug

SEQ ID NO: 3057 - RNA, 19 nt, Artificial Sequence
  Synthetic oligonucleotide
agaacuuuuuuaugcuuac

SEQ ID NO: 3058 - RNA, 19 nt, Artificial Sequence
  Synthetic oligonucleotide
uuuuuaugcuuaccaucuu

SEQ ID NO: 3059 - RNA, 19 nt, Artificial Sequence
  Synthetic oligonucleotide
augcuuaccaucuuuuuuu

SEQ ID NO: 3060 - RNA, 19 nt, Artificial Sequence
  Synthetic oligonucleotide
uaccaucuuuuuuuuuucu

SEQ ID NO: 3061 - RNA, 19 nt, Artificial Sequence
  Synthetic oligonucleotide
cuuuuuuuuuucuuuaaca

SEQ ID NO: 3062 - RNA, 19 nt, Artificial Sequence
  Synthetic oligonucleotide
uucuuuaacagauuuguau

SEQ ID NO: 3063 - RNA, 19 nt, Artificial Sequence
  Synthetic oligonucleotide
aacagauuuguauuuaaga

SEQ ID NO: 3064 - RNA, 19 nt, Artificial Sequence
  Synthetic oligonucleotide
uguauuuaagaauuguuuu

SEQ ID NO: 3065 - RNA, 19 nt, Artificial Sequence
  Synthetic oligonucleotide
aagaauuguuuuuaaaaaa

SEQ ID NO: 3066 - RNA, 19 nt, Artificial Sequence
  Synthetic oligonucleotide
acaauguuucucuguaaau

SEQ ID NO: 3067 - RNA, 19 nt, Artificial Sequence
  Synthetic oligonucleotide
cucuguaaauauugccauu

SEQ ID NO: 3068 - RNA, 19 nt, Artificial Sequence
  Synthetic oligonucleotide
uaaauauugccauuaaaug

SEQ ID NO: 3069 - RNA, 19 nt, Artificial Sequence
  Synthetic oligonucleotide
ugccauuaaauguaaauaa

SEQ ID NO: 3070 - RNA, 19 nt, Artificial Sequence
  Synthetic oligonucleotide
cuuuaauaaaacguuuaua

SEQ ID NO: 3071 - RNA, 19 nt, Artificial Sequence
  Synthetic oligonucleotide
cacagaauuucaauccuag

SEQ ID NO: 3072 - RNA, 19 nt, Artificial Sequence
  Synthetic oligonucleotide
accuaguauuauagguacu

SEQ ID NO: 3073 - RNA, 19 nt, Artificial Sequence
  Synthetic oligonucleotide
auuauagguacuauaaacc

SEQ ID NO: 3074 - RNA, 19 nt, Artificial Sequence
  Synthetic oligonucleotide
guacuauaaacccuaauuu

SEQ ID NO: 3075 - RNA, 19 nt, Artificial Sequence
  Synthetic oligonucleotide
aacccuaauuuuuuuuauu

SEQ ID NO: 3076 - RNA, 19 nt, Artificial Sequence
  Synthetic oligonucleotide
uaauuuuuuuuauuuaagu

SEQ ID NO: 3077 - RNA, 19 nt, Artificial Sequence
  Synthetic oligonucleotide
uuuauuuaaguacauuuug

SEQ ID NO: 3078 - RNA, 19 nt, Artificial Sequence
  Synthetic oligonucleotide
uuaaguacauuuugcuuuu

SEQ ID NO: 3079 - RNA, 19 nt, Artificial Sequence
  Synthetic oligonucleotide
acauuuugcuuuuuaaagu

SEQ ID NO: 3080 - RNA, 19 nt, Artificial Sequence
  Synthetic oligonucleotide
ugcuuuuuaaaguugauuu

SEQ ID NO: 3081 - RNA, 19 nt, Artificial Sequence
  Synthetic oligonucleotide
ucuauuguuuuuagaaaaa

SEQ ID NO: 3082 - RNA, 19 nt, Artificial Sequence
  Synthetic oligonucleotide
uguuuuuagaaaaaauaaa

SEQ ID NO: 3083 - RNA, 19 nt, Artificial Sequence
  Synthetic oligonucleotide
gaaaaaauaaaauaacugg

SEQ ID NO: 3084 - RNA, 19 nt, Artificial Sequence
  Synthetic oligonucleotide
aaaauaacuggcaaauaua

SEQ ID NO: 3085 - RNA, 19 nt, Artificial Sequence
  Synthetic oligonucleotide
ggcaaauauaucauugagc

SEQ ID NO: 3086 - RNA, 19 nt, Artificial Sequence
  Synthetic oligonucleotide
auaucauugagccaaaucu

SEQ ID NO: 3087 - RNA, 19 nt, Artificial Sequence
  Synthetic oligonucleotide
uugagccaaaucuuaaaaa

SEQ ID NO: 3088 - RNA, 19 nt, Artificial Sequence
  Synthetic oligonucleotide
uaacucgcuguaguaauuc

SEQ ID NO: 3089 - RNA, 19 nt, Artificial Sequence
  Synthetic oligonucleotide
aacucgcuguaguaauucc

SEQ ID NO: 3090 - RNA, 19 nt, Artificial Sequence
  Synthetic oligonucleotide
acucgcuguaguaauucca

SEQ ID NO: 3091 - RNA, 19 nt, Artificial Sequence
  Synthetic oligonucleotide
cucgcuguaguaauuccag

SEQ ID NO: 3092 - RNA, 19 nt, Artificial Sequence
  Synthetic oligonucleotide
ucgcuguaguaauuccagc

SEQ ID NO: 3093 - RNA, 19 nt, Artificial Sequence
  Synthetic oligonucleotide
cgcuguaguaauuccagcg

SEQ ID NO: 3094 - RNA, 19 nt, Artificial Sequence
  Synthetic oligonucleotide
gcuguaguaauuccagcga

SEQ ID NO: 3095 - RNA, 19 nt, Artificial Sequence
  Synthetic oligonucleotide
cuguaguaauuccagcgag

SEQ ID NO: 3096 - RNA, 19 nt, Artificial Sequence
  Synthetic oligonucleotide
agcuucaccaacaggaacu

SEQ ID NO: 3097 - RNA, 19 nt, Artificial Sequence
  Synthetic oligonucleotide
gcuucaccaacaggaacua

SEQ ID NO: 3098 - RNA, 19 nt, Artificial Sequence
  Synthetic oligonucleotide
cuucaccaacaggaacuau

SEQ ID NO: 3099 - RNA, 19 nt, Artificial Sequence
  Synthetic oligonucleotide
uucaccaacaggaacuaug

SEQ ID NO: 3100 - RNA, 19 nt, Artificial Sequence
  Synthetic oligonucleotide
ucaccaacaggaacuauga

SEQ ID NO: 3101 - RNA, 19 nt, Artificial Sequence
  Synthetic oligonucleotide
caccaacaggaacuaugac

SEQ ID NO: 3102 - RNA, 19 nt, Artificial Sequence
  Synthetic oligonucleotide
accaacaggaacuaugacc

SEQ ID NO: 3103 - RNA, 19 nt, Artificial Sequence
  Synthetic oligonucleotide
ccaacaggaacuaugaccu

SEQ ID NO: 3104 - RNA, 19 nt, Artificial Sequence
  Synthetic oligonucleotide
caacaggaacuaugaccuc

SEQ ID NO: 3105 - RNA, 19 nt, Artificial Sequence
  Synthetic oligonucleotide
aacaggaacuaugaccucg

SEQ ID NO: 3106 - RNA, 19 nt, Artificial Sequence
  Synthetic oligonucleotide
acaggaacuaugaccucga

SEQ ID NO: 3107 - RNA, 19 nt, Artificial Sequence
  Synthetic oligonucleotide
caggaacuaugaccucgac

SEQ ID NO: 3108 - RNA, 19 nt, Artificial Sequence
  Synthetic oligonucleotide
aggaacuaugaccucgacu

SEQ ID NO: 3109 - RNA, 19 nt, Artificial Sequence
  Synthetic oligonucleotide
ggaacuaugaccucgacua

SEQ ID NO: 3110 - RNA, 19 nt, Artificial Sequence
  Synthetic oligonucleotide
gaacuaugaccucgacuac

SEQ ID NO: 3111 - RNA, 19 nt, Artificial Sequence
  Synthetic oligonucleotide
aacuaugaccucgacuacg

SEQ ID NO: 3112 - RNA, 19 nt, Artificial Sequence
  Synthetic oligonucleotide
acuaugaccucgacuacga

SEQ ID NO: 3113 - RNA, 19 nt, Artificial Sequence
  Synthetic oligonucleotide
cuaugaccucgacuacgac

SEQ ID NO: 3114 - RNA, 19 nt, Artificial Sequence
  Synthetic oligonucleotide
gcgaggauaucuggaagaa

SEQ ID NO: 3115 - RNA, 19 nt, Artificial Sequence
  Synthetic oligonucleotide
cgaggauaucuggaagaaa

SEQ ID NO: 3116 - RNA, 19 nt, Artificial Sequence
  Synthetic oligonucleotide
gaggauaucuggaagaaau

SEQ ID NO: 3117 - RNA, 19 nt, Artificial Sequence
  Synthetic oligonucleotide
aggauaucuggaagaaauu

SEQ ID NO: 3118 - RNA, 19 nt, Artificial Sequence
  Synthetic oligonucleotide
ggauaucuggaagaaauuc

SEQ ID NO: 3119 - RNA, 19 nt, Artificial Sequence
  Synthetic oligonucleotide
gauaucuggaagaaauucg

SEQ ID NO: 3120 - RNA, 19 nt, Artificial Sequence
  Synthetic oligonucleotide
auaucuggaagaaauucga

SEQ ID NO: 3121 - RNA, 19 nt, Artificial Sequence
  Synthetic oligonucleotide
uaucuggaagaaauucgag

SEQ ID NO: 3122 - RNA, 19 nt, Artificial Sequence
  Synthetic oligonucleotide
aucuggaagaaauucgagc

SEQ ID NO: 3123 - RNA, 19 nt, Artificial Sequence
  Synthetic oligonucleotide
ucuggaagaaauucgagcu

SEQ ID NO: 3124 - RNA, 19 nt, Artificial Sequence
  Synthetic oligonucleotide
cuggaagaaauucgagcug

SEQ ID NO: 3125 - RNA, 19 nt, Artificial Sequence
  Synthetic oligonucleotide
cuagccgccgcuccgggcu

SEQ ID NO: 3126 - RNA, 19 nt, Artificial Sequence
  Synthetic oligonucleotide
uagccgccgcuccgggcuc

SEQ ID NO: 3127 - RNA, 19 nt, Artificial Sequence
  Synthetic oligonucleotide
agccgccgcuccgggcucu

SEQ ID NO: 3128 - RNA, 19 nt, Artificial Sequence
  Synthetic oligonucleotide
gccgccgcuccgggcucug

SEQ ID NO: 3129 - RNA, 19 nt, Artificial Sequence
  Synthetic oligonucleotide
ccgccgcuccgggcucugc

SEQ ID NO: 3130 - RNA, 19 nt, Artificial Sequence
  Synthetic oligonucleotide
ugggaggagacauggugaa

SEQ ID NO: 3131 - RNA, 19 nt, Artificial Sequence
  Synthetic oligonucleotide
gggaggagacauggugaac

SEQ ID NO: 3132 - RNA, 19 nt, Artificial Sequence
  Synthetic oligonucleotide
ggaggagacauggugaacc

SEQ ID NO: 3133 - RNA, 19 nt, Artificial Sequence
  Synthetic oligonucleotide
gaggagacauggugaacca

SEQ ID NO: 3134 - RNA, 19 nt, Artificial Sequence
  Synthetic oligonucleotide
aggagacauggugaaccag

SEQ ID NO: 3135 - RNA, 19 nt, Artificial Sequence
  Synthetic oligonucleotide
cggacgacgagaccuucau

SEQ ID NO: 3136 - RNA, 19 nt, Artificial Sequence
  Synthetic oligonucleotide
ggacgacgagaccuucauc

SEQ ID NO: 3137 - RNA, 19 nt, Artificial Sequence
  Synthetic oligonucleotide
aaaacaucaucauccagga

SEQ ID NO: 3138 - RNA, 19 nt, Artificial Sequence
  Synthetic oligonucleotide
aaacaucaucauccaggac

SEQ ID NO: 3139 - RNA, 19 nt, Artificial Sequence
  Synthetic oligonucleotide
aacaucaucauccaggacu

SEQ ID NO: 3140 - RNA, 19 nt, Artificial Sequence
  Synthetic oligonucleotide
acaucaucauccaggacug

SEQ ID NO: 3141 - RNA, 19 nt, Artificial Sequence
  Synthetic oligonucleotide
caucaucauccaggacugu

SEQ ID NO: 3142 - RNA, 19 nt, Artificial Sequence
  Synthetic oligonucleotide
aucaucauccaggacugua

SEQ ID NO: 3143 - RNA, 19 nt, Artificial Sequence
  Synthetic oligonucleotide
ucaucauccaggacuguau

SEQ ID NO: 3144 - RNA, 19 nt, Artificial Sequence
  Synthetic oligonucleotide
caucauccaggacuguaug

SEQ ID NO: 3145 - RNA, 19 nt, Artificial Sequence
  Synthetic oligonucleotide
aucauccaggacuguaugu

SEQ ID NO: 3146 - RNA, 19 nt, Artificial Sequence
  Synthetic oligonucleotide
ucauccaggacuguaugug

SEQ ID NO: 3147 - RNA, 19 nt, Artificial Sequence
  Synthetic oligonucleotide
cauccaggacuguaugugg

SEQ ID NO: 3148 - RNA, 19 nt, Artificial Sequence
  Synthetic oligonucleotide
auccaggacuguaugugga

SEQ ID NO: 3149 - RNA, 19 nt, Artificial Sequence
  Synthetic oligonucleotide
uccaggacuguauguggag

SEQ ID NO: 3150 - RNA, 19 nt, Artificial Sequence
  Synthetic oligonucleotide
ccaggacuguauguggagc

SEQ ID NO: 3151 - RNA, 19 nt, Artificial Sequence
  Synthetic oligonucleotide
cagagaagcuggccuccua

SEQ ID NO: 3152 - RNA, 19 nt, Artificial Sequence
  Synthetic oligonucleotide
agagaagcuggccuccuac

SEQ ID NO: 3153 - RNA, 19 nt, Artificial Sequence
  Synthetic oligonucleotide
gagaagcuggccuccuacc

SEQ ID NO: 3154 - RNA, 19 nt, Artificial Sequence
  Synthetic oligonucleotide
agaagcuggccuccuacca

SEQ ID NO: 3155 - RNA, 19 nt, Artificial Sequence
  Synthetic oligonucleotide
gaagcuggccuccuaccag

SEQ ID NO: 3156 - RNA, 19 nt, Artificial Sequence
  Synthetic oligonucleotide
aagcuggccuccuaccagg

SEQ ID NO: 3157 - RNA, 19 nt, Artificial Sequence
  Synthetic oligonucleotide
agcuggccuccuaccaggc

SEQ ID NO: 3158 - RNA, 19 nt, Artificial Sequence
  Synthetic oligonucleotide
gcuggccuccuaccaggcu

SEQ ID NO: 3159 - RNA, 19 nt, Artificial Sequence
  Synthetic oligonucleotide
cuggccuccuaccaggcug

SEQ ID NO: 3160 - RNA, 19 nt, Artificial Sequence
  Synthetic oligonucleotide
uggccuccuaccaggcugc

SEQ ID NO: 3161 - RNA, 19 nt, Artificial Sequence
  Synthetic oligonucleotide
ggccuccuaccaggcugcg

SEQ ID NO: 3162 - RNA, 19 nt, Artificial Sequence
  Synthetic oligonucleotide
gccuccuaccaggcugcgc

SEQ ID NO: 3163 - RNA, 19 nt, Artificial Sequence
  Synthetic oligonucleotide
ccuccuaccaggcugcgcg

SEQ ID NO: 3164 - RNA, 19 nt, Artificial Sequence
  Synthetic oligonucleotide
cuccuaccaggcugcgcgc

SEQ ID NO: 3165 - RNA, 19 nt, Artificial Sequence
  Synthetic oligonucleotide
uccuaccaggcugcgcgca

SEQ ID NO: 3166 - RNA, 19 nt, Artificial Sequence
  Synthetic oligonucleotide
ccuaccaggcugcgcgcaa

SEQ ID NO: 3167 - RNA, 19 nt, Artificial Sequence
  Synthetic oligonucleotide
cuaccaggcugcgcgcaaa

SEQ ID NO: 3168 - RNA, 19 nt, Artificial Sequence
  Synthetic oligonucleotide
uaccaggcugcgcgcaaag

SEQ ID NO: 3169 - RNA, 19 nt, Artificial Sequence
  Synthetic oligonucleotide
accaggcugcgcgcaaaga

SEQ ID NO: 3170 - RNA, 19 nt, Artificial Sequence
  Synthetic oligonucleotide
ccaggcugcgcgcaaagac

SEQ ID NO: 3171 - RNA, 19 nt, Artificial Sequence
  Synthetic oligonucleotide
caggcugcgcgcaaagaca

SEQ ID NO: 3172 - RNA, 19 nt, Artificial Sequence
  Synthetic oligonucleotide
gccacagcgucugcuccac

SEQ ID NO: 3173 - RNA, 19 nt, Artificial Sequence
  Synthetic oligonucleotide
ccacagcgucugcuccacc

SEQ ID NO: 3174 - RNA, 19 nt, Artificial Sequence
  Synthetic oligonucleotide
cacagcgucugcuccaccu

SEQ ID NO: 3175 - RNA, 19 nt, Artificial Sequence
  Synthetic oligonucleotide
acagcgucugcuccaccuc

SEQ ID NO: 3176 - RNA, 19 nt, Artificial Sequence
  Synthetic oligonucleotide
cagcgucugcuccaccucc

SEQ ID NO: 3177 - RNA, 19 nt, Artificial Sequence
  Synthetic oligonucleotide
agcgucugcuccaccucca

SEQ ID NO: 3178 - RNA, 19 nt, Artificial Sequence
  Synthetic oligonucleotide
cucucaacgacagcagcuc

SEQ ID NO: 3179 - RNA, 19 nt, Artificial Sequence
  Synthetic oligonucleotide
ucucaacgacagcagcucg

SEQ ID NO: 3180 - RNA, 19 nt, Artificial Sequence
  Synthetic oligonucleotide
cucaacgacagcagcucgc

SEQ ID NO: 3181 - RNA, 19 nt, Artificial Sequence
  Synthetic oligonucleotide
ucaacgacagcagcucgcc

SEQ ID NO: 3182 - RNA, 19 nt, Artificial Sequence
  Synthetic oligonucleotide
caacgacagcagcucgccc

SEQ ID NO: 3183 - RNA, 19 nt, Artificial Sequence
  Synthetic oligonucleotide
uccaugaggagacaccgcc

SEQ ID NO: 3184 - RNA, 19 nt, Artificial Sequence
  Synthetic oligonucleotide
ccaugaggagacaccgccc

SEQ ID NO: 3185 - RNA, 19 nt, Artificial Sequence
  Synthetic oligonucleotide
caugaggagacaccgccca

SEQ ID NO: 3186 - RNA, 19 nt, Artificial Sequence
  Synthetic oligonucleotide
augaggagacaccgcccac

SEQ ID NO: 3187 - RNA, 19 nt, Artificial Sequence
  Synthetic oligonucleotide
ugaggagacaccgcccacc

SEQ ID NO: 3188 - RNA, 19 nt, Artificial Sequence
  Synthetic oligonucleotide
gaggagacaccgcccacca

SEQ ID NO: 3189 - RNA, 19 nt, Artificial Sequence
  Synthetic oligonucleotide
aggagacaccgcccaccac

SEQ ID NO: 3190 - RNA, 19 nt, Artificial Sequence
  Synthetic oligonucleotide
ggagacaccgcccaccacc

SEQ ID NO: 3191 - RNA, 19 nt, Artificial Sequence
  Synthetic oligonucleotide
gagacaccgcccaccacca

SEQ ID NO: 3192 - RNA, 19 nt, Artificial Sequence
  Synthetic oligonucleotide
agacaccgcccaccaccag

SEQ ID NO: 3193 - RNA, 19 nt, Artificial Sequence
  Synthetic oligonucleotide
gacaccgcccaccaccagc

SEQ ID NO: 3194 - RNA, 19 nt, Artificial Sequence
  Synthetic oligonucleotide
acaccgcccaccaccagca

SEQ ID NO: 3195 - RNA, 19 nt, Artificial Sequence
  Synthetic oligonucleotide
caccgcccaccaccagcag

SEQ ID NO: 3196 - RNA, 19 nt, Artificial Sequence
  Synthetic oligonucleotide
accgcccaccaccagcagc

SEQ ID NO: 3197 - RNA, 19 nt, Artificial Sequence
  Synthetic oligonucleotide
ccgcccaccaccagcagcg

SEQ ID NO: 3198 - RNA, 19 nt, Artificial Sequence
  Synthetic oligonucleotide
cgcccaccaccagcagcga

SEQ ID NO: 3199 - RNA, 19 nt, Artificial Sequence
  Synthetic oligonucleotide
gcccaccaccagcagcgac

SEQ ID NO: 3200 - RNA, 19 nt, Artificial Sequence
  Synthetic oligonucleotide
cccaccaccagcagcgacu

SEQ ID NO: 3201 - RNA, 19 nt, Artificial Sequence
  Synthetic oligonucleotide
ccaccaccagcagcgacuc

SEQ ID NO: 3202 - RNA, 19 nt, Artificial Sequence
  Synthetic oligonucleotide
caccaccagcagcgacucu

SEQ ID NO: 3203 - RNA, 19 nt, Artificial Sequence
  Synthetic oligonucleotide
aacaagaagaugaggaaga

SEQ ID NO: 3204 - RNA, 19 nt, Artificial Sequence
  Synthetic oligonucleotide
acaagaagaugaggaagaa

SEQ ID NO: 3205 - RNA, 19 nt, Artificial Sequence
  Synthetic oligonucleotide
uggaggccacagcaaaccu

SEQ ID NO: 3206 - RNA, 19 nt, Artificial Sequence
  Synthetic oligonucleotide
cucacagcccacugguccu

SEQ ID NO: 3207 - RNA, 19 nt, Artificial Sequence
  Synthetic oligonucleotide
ucacagcccacugguccuc

SEQ ID NO: 3208 - RNA, 19 nt, Artificial Sequence
  Synthetic oligonucleotide
cacagcccacugguccuca

SEQ ID NO: 3209 - RNA, 19 nt, Artificial Sequence
  Synthetic oligonucleotide
acagcccacugguccucaa

SEQ ID NO: 3210 - RNA, 19 nt, Artificial Sequence
  Synthetic oligonucleotide
cagcccacugguccucaag

SEQ ID NO: 3211 - RNA, 19 nt, Artificial Sequence
  Synthetic oligonucleotide
agcccacugguccucaaga

SEQ ID NO: 3212 - RNA, 19 nt, Artificial Sequence
  Synthetic oligonucleotide
gcccacugguccucaagag

SEQ ID NO: 3213 - RNA, 19 nt, Artificial Sequence
  Synthetic oligonucleotide
cccacugguccucaagagg

SEQ ID NO: 3214 - RNA, 19 nt, Artificial Sequence
  Synthetic oligonucleotide
ccacugguccucaagaggu

SEQ ID NO: 3215 - RNA, 19 nt, Artificial Sequence
  Synthetic oligonucleotide
cacugguccucaagaggug

SEQ ID NO: 3216 - RNA, 19 nt, Artificial Sequence
  Synthetic oligonucleotide
acugguccucaagaggugc

SEQ ID NO: 3217 - RNA, 19 nt, Artificial Sequence
  Synthetic oligonucleotide
cugguccucaagaggugcc

SEQ ID NO: 3218 - RNA, 19 nt, Artificial Sequence
  Synthetic oligonucleotide
ugguccucaagaggugcca

SEQ ID NO: 3219 - RNA, 19 nt, Artificial Sequence
  Synthetic oligonucleotide
gguccucaagaggugccac

SEQ ID NO: 3220 - RNA, 19 nt, Artificial Sequence
  Synthetic oligonucleotide
guccucaagaggugccacg

SEQ ID NO: 3221 - RNA, 19 nt, Artificial Sequence
  Synthetic oligonucleotide
uccucaagaggugccacgu

SEQ ID NO: 3222 - RNA, 19 nt, Artificial Sequence
  Synthetic oligonucleotide
ggagcuuuuuugcccugcg

SEQ ID NO: 3223 - RNA, 19 nt, Artificial Sequence
  Synthetic oligonucleotide
gagcuuuuuugcccugcgu

SEQ ID NO: 3224 - RNA, 19 nt, Artificial Sequence
  Synthetic oligonucleotide
agcuuuuuugcccugcgug

SEQ ID NO: 3225 - RNA, 19 nt, Artificial Sequence
  Synthetic oligonucleotide
gcuuuuuugcccugcguga

SEQ ID NO: 3226 - RNA, 19 nt, Artificial Sequence
  Synthetic oligonucleotide
cuuuuuugcccugcgugac

SEQ ID NO: 3227 - RNA, 19 nt, Artificial Sequence
  Synthetic oligonucleotide
uuuuuugcccugcgugacc

SEQ ID NO: 3228 - RNA, 19 nt, Artificial Sequence
  Synthetic oligonucleotide
uuuuugcccugcgugacca

SEQ ID NO: 3229 - RNA, 19 nt, Artificial Sequence
  Synthetic oligonucleotide
uuuugcccugcgugaccag

SEQ ID NO: 3230 - RNA, 19 nt, Artificial Sequence
  Synthetic oligonucleotide
uuugcccugcgugaccaga

SEQ ID NO: 3231 - RNA, 19 nt, Artificial Sequence
  Synthetic oligonucleotide
uugcccugcgugaccagau

SEQ ID NO: 3232 - RNA, 19 nt, Artificial Sequence
  Synthetic oligonucleotide
ugcccugcgugaccagauc

SEQ ID NO: 3233 - RNA, 19 nt, Artificial Sequence
  Synthetic oligonucleotide
gcggaaacgacgagaacag

SEQ ID NO: 3234 - RNA, 19 nt, Artificial Sequence
  Synthetic oligonucleotide
cggaaacgacgagaacagu

SEQ ID NO: 3235 - RNA, 19 nt, Artificial Sequence
  Synthetic oligonucleotide
ucuuuaacagauuuguauu

SEQ ID NO: 3236 - RNA, 19 nt, Artificial Sequence
  Synthetic oligonucleotide
cuuuaacagauuuguauuu

SEQ ID NO: 3237 - RNA, 19 nt, Artificial Sequence
  Synthetic oligonucleotide
uuaaauguaaauaacuuua

SEQ ID NO: 3238 - RNA, 19 nt, Artificial Sequence
  Synthetic oligonucleotide
uaaauguaaauaacuuuaa

SEQ ID NO: 3239 - RNA, 19 nt, Artificial Sequence
  Synthetic oligonucleotide
aaauguaaauaacuuuaau

SEQ ID NO: 3240 - RNA, 19 nt, Artificial Sequence
  Synthetic oligonucleotide
aauguaaauaacuuuaaua

SEQ ID NO: 3241 - RNA, 19 nt, Artificial Sequence
  Synthetic oligonucleotide
auguaaauaacuuuaauaa

SEQ ID NO: 3242 - RNA, 19 nt, Artificial Sequence
  Synthetic oligonucleotide
uguaaauaacuuuaauaaa

SEQ ID NO: 3243 - RNA, 19 nt, Artificial Sequence
  Synthetic oligonucleotide
guaaauaacuuuaauaaaa

SEQ ID NO: 3244 - RNA, 19 nt, Artificial Sequence
  Synthetic oligonucleotide
uaaauaacuuuaauaaaac

SEQ ID NO: 3245 - RNA, 19 nt, Artificial Sequence
  Synthetic oligonucleotide
aaauaacuuuaauaaaacg

SEQ ID NO: 3246 - RNA, 19 nt, Artificial Sequence
  Synthetic oligonucleotide
aauaacuuuaauaaaacgu

SEQ ID NO: 3247 - RNA, 19 nt, Artificial Sequence
  Synthetic oligonucleotide
auaacuuuaauaaaacguu

SEQ ID NO: 3248 - RNA, 19 nt, Artificial Sequence
  Synthetic oligonucleotide
uaacuuuaauaaaacguuu

SEQ ID NO: 3249 - RNA, 19 nt, Artificial Sequence
  Synthetic oligonucleotide
aacuuuaauaaaacguuua

SEQ ID NO: 3250 - RNA, 19 nt, Artificial Sequence
  Synthetic oligonucleotide
gcuuuuuaaaguugauuuu

SEQ ID NO: 3251 - RNA, 19 nt, Artificial Sequence
  Synthetic oligonucleotide
cuuuuuaaaguugauuuuu

SEQ ID NO: 3252 - RNA, 19 nt, Artificial Sequence
  Synthetic oligonucleotide
uuuuuaaaguugauuuuuu

SEQ ID NO: 3253 - RNA, 19 nt, Artificial Sequence
  Synthetic oligonucleotide
uuuuaaaguugauuuuuuu

SEQ ID NO: 3254 - RNA, 19 nt, Artificial Sequence
  Synthetic oligonucleotide
uuuaaaguugauuuuuuuc

SEQ ID NO: 3255 - RNA, 19 nt, Artificial Sequence
  Synthetic oligonucleotide
uuaaaguugauuuuuuucu

SEQ ID NO: 3256 - RNA, 19 nt, Artificial Sequence
  Synthetic oligonucleotide
uaaaguugauuuuuuucua

SEQ ID NO: 3257 - RNA, 19 nt, Artificial Sequence
  Synthetic oligonucleotide
aaaguugauuuuuuucuau

SEQ ID NO: 3258 - RNA, 19 nt, Artificial Sequence
  Synthetic oligonucleotide
aaguugauuuuuuucuauu

SEQ ID NO: 3259 - RNA, 19 nt, Artificial Sequence
  Synthetic oligonucleotide
aguugauuuuuuucuauug

SEQ ID NO: 3260 - RNA, 19 nt, Artificial Sequence
  Synthetic oligonucleotide
guugauuuuuuucuauugu

SEQ ID NO: 3261 - RNA, 19 nt, Artificial Sequence
  Synthetic oligonucleotide
uugauuuuuuucuauuguu

SEQ ID NO: 3262 - RNA, 19 nt, Artificial Sequence
  Synthetic oligonucleotide
ugauuuuuuucuauuguuu

SEQ ID NO: 3263 - RNA, 19 nt, Artificial Sequence
  Synthetic oligonucleotide
gauuuuuuucuauuguuuu

SEQ ID NO: 3264 - RNA, 19 nt, Artificial Sequence
  Synthetic oligonucleotide
auuuuuuucuauuguuuuu

SEQ ID NO: 3265 - RNA, 19 nt, Artificial Sequence
  Synthetic oligonucleotide
uuuuuuucuauuguuuuua

SEQ ID NO: 3266 - RNA, 19 nt, Artificial Sequence
  Synthetic oligonucleotide
uuuuuucuauuguuuuuag

SEQ ID NO: 3267 - RNA, 19 nt, Artificial Sequence
  Synthetic oligonucleotide
uuuuucuauuguuuuuaga

SEQ ID NO: 3268 - RNA, 19 nt, Artificial Sequence
  Synthetic oligonucleotide
uuuucuauuguuuuuagaa

SEQ ID NO: 3269 - RNA, 19 nt, Artificial Sequence
  Synthetic oligonucleotide
uuucuauuguuuuuagaaa

SEQ ID NO: 3270 - RNA, 19 nt, Artificial Sequence
  Synthetic oligonucleotide
uucuauuguuuuuagaaaa

SEQ ID NO: 3271 - DNA, 25 bp, Artificial Sequence
  Synthetic oligonucleotide
ggauccugagucgcaguauaaaaga

SEQ ID NO: 3272 - DNA, 25 bp, Artificial Sequence
  Synthetic oligonucleotide
gagucgcaguauaaaagaagcuutt

SEQ ID NO: 3273 - DNA, 25 bp, Artificial Sequence
  Synthetic oligonucleotide
gcaguauaaaagaagcuuuucgggc

SEQ ID NO: 3274 - DNA, 25 bp, Artificial Sequence
  Synthetic oligonucleotide
gaagcuuuucgggcguuuuuuuctg

SEQ ID NO: 3275 - DNA, 25 bp, Artificial Sequence
  Synthetic oligonucleotide
cguuuuuuucugacucgcuguagta

SEQ ID NO: 3276 - DNA, 25 bp, Artificial Sequence
  Synthetic oligonucleotide
agggagugagcggacgguuggaaga

SEQ ID NO: 3277 - DNA, 25 bp, Artificial Sequence
  Synthetic oligonucleotide
agcggacgguuggaagagccgugtg

SEQ ID NO: 3278 - DNA, 25 bp, Artificial Sequence
  Synthetic oligonucleotide
ccuaagaaggcagcucuggagugag

SEQ ID NO: 3279 - DNA, 25 bp, Artificial Sequence
  Synthetic oligonucleotide
acccugcgacugacccaacaucagc

SEQ ID NO: 3280 - DNA, 25 bp, Artificial Sequence
  Synthetic oligonucleotide
gcagacacuucucacuggaacuuac

SEQ ID NO: 3281 - DNA, 25 bp, Artificial Sequence
  Synthetic oligonucleotide
cacuucucacuggaacuuacaauct

SEQ ID NO: 3282 - DNA, 25 bp, Artificial Sequence
  Synthetic oligonucleotide
cuggaacuuacaaucugcgagccag

SEQ ID NO: 3283 - DNA, 25 bp, Artificial Sequence
  Synthetic oligonucleotide
acaaucugcgagccaggacaggact

SEQ ID NO: 3284 - DNA, 25 bp, Artificial Sequence
  Synthetic oligonucleotide
aagagcuccucgagcuguuugaagg

SEQ ID NO: 3285 - DNA, 25 bp, Artificial Sequence
  Synthetic oligonucleotide
cgagcuguuugaaggcuggauuucc

SEQ ID NO: 3286 - DNA, 25 bp, Artificial Sequence
  Synthetic oligonucleotide
guuugaaggcuggauuuccuuuggg

SEQ ID NO: 3287 - DNA, 25 bp, Artificial Sequence
  Synthetic oligonucleotide
gauuuccuuugggcguuggaaaccc

SEQ ID NO: 3288 - DNA, 25 bp, Artificial Sequence
  Synthetic oligonucleotide
cucaacgugaacuucaccaacagga

SEQ ID NO: 3289 - DNA, 25 bp, Artificial Sequence
  Synthetic oligonucleotide
gugaacuucaccaacaggaacuatg

SEQ ID NO: 3290 - DNA, 25 bp, Artificial Sequence
  Synthetic oligonucleotide
gacuccguacagcccuauuucauct

SEQ ID NO: 3291 - DNA, 25 bp, Artificial Sequence
  Synthetic oligonucleotide
gcgacgaggaagagaauuucuauca

SEQ ID NO: 3292 - DNA, 25 bp, Artificial Sequence
  Synthetic oligonucleotide
gaagagaauuucuaucaccagcaac

SEQ ID NO: 3293 - DNA, 25 bp, Artificial Sequence
  Synthetic oligonucleotide
gugaggauaucuggaagaaauucga

SEQ ID NO: 3294 - DNA, 25 bp, Artificial Sequence
  Synthetic oligonucleotide
gaagaaauucgagcugcuucccacc

SEQ ID NO: 3295 - DNA, 25 bp, Artificial Sequence
  Synthetic oligonucleotide
gggcucugcucuccauccuaugutg

SEQ ID NO: 3296 - DNA, 25 bp, Artificial Sequence
  Synthetic oligonucleotide
cugcucuccauccuauguugcggtc

SEQ ID NO: 3297 - DNA, 25 bp, Artificial Sequence
  Synthetic oligonucleotide
uccuauguugcggucgcuacgucct

SEQ ID NO: 3298 - DNA, 25 bp, Artificial Sequence
  Synthetic oligonucleotide
guugcggucgcuacguccuucuccc

SEQ ID NO: 3299 - DNA, 25 bp, Artificial Sequence
  Synthetic oligonucleotide
ccgaucagcuggagaugaugaccga

SEQ ID NO: 3300 - DNA, 25 bp, Artificial Sequence
  Synthetic oligonucleotide
cuggagaugaugaccgaguuacutg

SEQ ID NO: 3301 - DNA, 25 bp, Artificial Sequence
  Synthetic oligonucleotide
gaugaccgaguuacuuggaggagac

SEQ ID NO: 3302 - DNA, 25 bp, Artificial Sequence
  Synthetic oligonucleotide
aguuacuuggaggagacauggugaa

SEQ ID NO: 3303 - DNA, 25 bp, Artificial Sequence
  Synthetic oligonucleotide
cuuggaggagacauggugaaccaga

SEQ ID NO: 3304 - DNA, 25 bp, Artificial Sequence
  Synthetic oligonucleotide
cauggugaaccagagcuucaucugc

SEQ ID NO: 3305 - DNA, 25 bp, Artificial Sequence
  Synthetic oligonucleotide
ccagagcuucaucugcgauccugac

SEQ ID NO: 3306 - DNA, 25 bp, Artificial Sequence
  Synthetic oligonucleotide
gcuucaucugcgauccugacgacga

SEQ ID NO: 3307 - DNA, 25 bp, Artificial Sequence
  Synthetic oligonucleotide
ucugcgauccugacgacgagacctt

SEQ ID NO: 3308 - DNA, 25 bp, Artificial Sequence
  Synthetic oligonucleotide
auccugacgacgagaccuucaucaa

SEQ ID NO: 3309 - DNA, 25 bp, Artificial Sequence
  Synthetic oligonucleotide
gacgagaccuucaucaagaacauca

SEQ ID NO: 3310 - DNA, 25 bp, Artificial Sequence
  Synthetic oligonucleotide
accuucaucaagaacaucaucaucc

SEQ ID NO: 3311 - DNA, 25 bp, Artificial Sequence
  Synthetic oligonucleotide
aagaacaucaucauccaggacugta

SEQ ID NO: 3312 - DNA, 25 bp, Artificial Sequence
  Synthetic oligonucleotide
ggacuguauguggagcgguuucuca

SEQ ID NO: 3313 - DNA, 25 bp, Artificial Sequence
  Synthetic oligonucleotide
ugcuccaccuccagccuguaccugc

SEQ ID NO: 3314 - DNA, 25 bp, Artificial Sequence
  Synthetic oligonucleotide
accuccagccuguaccugcaggacc

SEQ ID NO: 3315 - DNA, 25 bp, Artificial Sequence
  Synthetic oligonucleotide
agccuguaccugcaggaccucaccg

SEQ ID NO: 3316 - DNA, 25 bp, Artificial Sequence
  Synthetic oligonucleotide
gcagcucgcccaaauccuguacctc

SEQ ID NO: 3317 - DNA, 25 bp, Artificial Sequence
  Synthetic oligonucleotide
aaauccuguaccucguccgauucca

SEQ ID NO: 3318 - DNA, 25 bp, Artificial Sequence
  Synthetic oligonucleotide
caccagcagcgacucugaagaagag

SEQ ID NO: 3319 - DNA, 25 bp, Artificial Sequence
  Synthetic oligonucleotide
gcagcgacucugaagaagagcaaga

SEQ ID NO: 3320 - DNA, 25 bp, Artificial Sequence
  Synthetic oligonucleotide
acucugaagaagagcaagaagauga

SEQ ID NO: 3321 - DNA, 25 bp, Artificial Sequence
  Synthetic oligonucleotide
gaagaagagcaagaagaugaggaag

SEQ ID NO: 3322 - DNA, 25 bp, Artificial Sequence
  Synthetic oligonucleotide
agcaagaagaugaggaagaaauuga

SEQ ID NO: 3323 - DNA, 25 bp, Artificial Sequence
  Synthetic oligonucleotide
aagaugaggaagaaauugauguggt

SEQ ID NO: 3324 - DNA, 25 bp, Artificial Sequence
  Synthetic oligonucleotide
aggaagaaauugauguggugucugt

SEQ ID NO: 3325 - DNA, 25 bp, Artificial Sequence
  Synthetic oligonucleotide
gaaauugauguggugucuguggaga

SEQ ID NO: 3326 - DNA, 25 bp, Artificial Sequence
  Synthetic oligonucleotide
gauguggugucuguggagaagaggc

SEQ ID NO: 3327 - DNA, 25 bp, Artificial Sequence
  Synthetic oligonucleotide
gugucuguggagaagaggcaaaccc

SEQ ID NO: 3328 - DNA, 25 bp, Artificial Sequence
  Synthetic oligonucleotide
gccaagaggucggagucgggcucat

SEQ ID NO: 3329 - DNA, 25 bp, Artificial Sequence
  Synthetic oligonucleotide
caagaggugccacgucuccacucac

SEQ ID NO: 3330 - DNA, 25 bp, Artificial Sequence
  Synthetic oligonucleotide
gucuccacucaccagcacaacuacg

SEQ ID NO: 3331 - DNA, 25 bp, Artificial Sequence
  Synthetic oligonucleotide
gccaagagggccaaguuggacagtg

SEQ ID NO: 3332 - DNA, 25 bp, Artificial Sequence
  Synthetic oligonucleotide
gagggccaaguuggacaguggcagg

SEQ ID NO: 3333 - DNA, 25 bp, Artificial Sequence
  Synthetic oligonucleotide
aguuggacaguggcaggguccugaa

SEQ ID NO: 3334 - DNA, 25 bp, Artificial Sequence
  Synthetic oligonucleotide
gacaguggcaggguccugaagcaga

SEQ ID NO: 3335 - DNA, 25 bp, Artificial Sequence
  Synthetic oligonucleotide
ggcaggguccugaagcagaucagca

SEQ ID NO: 3336 - DNA, 25 bp, Artificial Sequence
  Synthetic oligonucleotide
guccugaagcagaucagcaacaacc

SEQ ID NO: 3337 - DNA, 25 bp, Artificial Sequence
  Synthetic oligonucleotide
gaagcagaucagcaacaaccgcaag

SEQ ID NO: 3338 - DNA, 25 bp, Artificial Sequence
  Synthetic oligonucleotide
cgagcugaagcgcagcuuuuuugcc

SEQ ID NO: 3339 - DNA, 25 bp, Artificial Sequence
  Synthetic oligonucleotide
gcagcuuuuuugcccugcgugacca

SEQ ID NO: 3340 - DNA, 25 bp, Artificial Sequence
  Synthetic oligonucleotide
ccugcgugaccagaucccugaautg

SEQ ID NO: 3341 - DNA, 25 bp, Artificial Sequence
  Synthetic oligonucleotide
accagaucccugaauuggaaaacaa

SEQ ID NO: 3342 - DNA, 25 bp, Artificial Sequence
  Synthetic oligonucleotide
cugaauuggaaaacaacgaaaaggc

SEQ ID NO: 3343 - DNA, 25 bp, Artificial Sequence
  Synthetic oligonucleotide
agguagugauccucaaaaaagccac

SEQ ID NO: 3344 - DNA, 25 bp, Artificial Sequence
  Synthetic oligonucleotide
caaaaaagccaccgccuacaucctg

SEQ ID NO: 3345 - DNA, 25 bp, Artificial Sequence
  Synthetic oligonucleotide
gccaccgccuacauccuguccautc

SEQ ID NO: 3346 - DNA, 25 bp, Artificial Sequence
  Synthetic oligonucleotide
cgccuacauccuguccauucaagca

SEQ ID NO: 3347 - DNA, 25 bp, Artificial Sequence
  Synthetic oligonucleotide
acauccuguccauucaagcagacga

SEQ ID NO: 3348 - DNA, 25 bp, Artificial Sequence
  Synthetic oligonucleotide
cuguccauucaagcagacgagcaca

SEQ ID NO: 3349 - DNA, 25 bp, Artificial Sequence
  Synthetic oligonucleotide
cagacgagcacaagcucaccucuga

SEQ ID NO: 3350 - DNA, 25 bp, Artificial Sequence
  Synthetic oligonucleotide
agcacaagcucaccucugaaaagga

SEQ ID NO: 3351 - DNA, 25 bp, Artificial Sequence
  Synthetic oligonucleotide
cucaccucugaaaaggacuuauuga

SEQ ID NO: 3352 - DNA, 25 bp, Artificial Sequence
  Synthetic oligonucleotide
gaaaaggacuuauugaggaaacgac

SEQ ID NO: 3353 - DNA, 25 bp, Artificial Sequence
  Synthetic oligonucleotide
gaggaaacgacgagaacaguugaaa

SEQ ID NO: 3354 - DNA, 25 bp, Artificial Sequence
  Synthetic oligonucleotide
aaacucgaacagcuucgaaacuctg

SEQ ID NO: 3355 - DNA, 25 bp, Artificial Sequence
  Synthetic oligonucleotide
cgaacagcuucgaaacucuggugca

SEQ ID NO: 3356 - DNA, 25 bp, Artificial Sequence
  Synthetic oligonucleotide
uucgaaacucuggugcauaaacuga

SEQ ID NO: 3357 - DNA, 25 bp, Artificial Sequence
  Synthetic oligonucleotide
acucuggugcauaaacugaccuaac

SEQ ID NO: 3358 - DNA, 25 bp, Artificial Sequence
  Synthetic oligonucleotide
gugcauaaacugaccuaacucgagg

SEQ ID NO: 3359 - DNA, 25 bp, Artificial Sequence
  Synthetic oligonucleotide
aggaggagcuggaaucucucgugag

SEQ ID NO: 3360 - DNA, 25 bp, Artificial Sequence
  Synthetic oligonucleotide
ggaaucucucgugagaguaaggaga

SEQ ID NO: 3361 - DNA, 25 bp, Artificial Sequence
  Synthetic oligonucleotide
cucgugagaguaaggagaacggutc

SEQ ID NO: 3362 - DNA, 25 bp, Artificial Sequence
  Synthetic oligonucleotide
guaaggagaacgguuccuucugaca

SEQ ID NO: 3363 - DNA, 25 bp, Artificial Sequence
  Synthetic oligonucleotide
gagaacgguuccuucugacagaact

SEQ ID NO: 3364 - DNA, 25 bp, Artificial Sequence
  Synthetic oligonucleotide
cgguuccuucugacagaacugaugc

SEQ ID NO: 3365 - DNA, 25 bp, Artificial Sequence
  Synthetic oligonucleotide
cagaacugaugcgcuggaauuaaaa

SEQ ID NO: 3366 - DNA, 25 bp, Artificial Sequence
  Synthetic oligonucleotide
cugaugcgcuggaauuaaaaugcat

SEQ ID NO: 3367 - DNA, 25 bp, Artificial Sequence
  Synthetic oligonucleotide
gcgcuggaauuaaaaugcaugcuca

SEQ ID NO: 3368 - DNA, 25 bp, Artificial Sequence
  Synthetic oligonucleotide
ggaauuaaaaugcaugcucaaagcc

SEQ ID NO: 3369 - DNA, 25 bp, Artificial Sequence
  Synthetic oligonucleotide
aaaugcaugcucaaagccuaacctc

SEQ ID NO: 3370 - DNA, 25 bp, Artificial Sequence
  Synthetic oligonucleotide
gcucaaagccuaaccucacaacctt

SEQ ID NO: 3371 - DNA, 25 bp, Artificial Sequence
  Synthetic oligonucleotide
aagccuaaccucacaaccuuggctg

SEQ ID NO: 3372 - DNA, 25 bp, Artificial Sequence
  Synthetic oligonucleotide
gcuuugggacuguaagcuucagcca

SEQ ID NO: 3373 - DNA, 25 bp, Artificial Sequence
  Synthetic oligonucleotide
gacuguaagcuucagccauaauutt

SEQ ID NO: 3374 - DNA, 25 bp, Artificial Sequence
  Synthetic oligonucleotide
agcuucagccauaauuuuaacugcc

SEQ ID NO: 3375 - DNA, 25 bp, Artificial Sequence
  Synthetic oligonucleotide
gccauaauuuuaacugccucaaact

SEQ ID NO: 3376 - DNA, 25 bp, Artificial Sequence
  Synthetic oligonucleotide
uuuaacugccucaaacuuaaauagt

SEQ ID NO: 3377 - DNA, 25 bp, Artificial Sequence
  Synthetic oligonucleotide
ugccucaaacuuaaauaguauaaaa

SEQ ID NO: 3378 - DNA, 25 bp, Artificial Sequence
  Synthetic oligonucleotide
caaacuuaaauaguauaaaagaact

SEQ ID NO: 3379 - DNA, 25 bp, Artificial Sequence
  Synthetic oligonucleotide
aaauaguauaaaagaacuuuuuutt

SEQ ID NO: 3380 - DNA, 25 bp, Artificial Sequence
  Synthetic oligonucleotide
uauaaaagaacuuuuuuuuaugctt

SEQ ID NO: 3381 - DNA, 25 bp, Artificial Sequence
  Synthetic oligonucleotide
aagaacuuuuuuuuaugcuucccat

SEQ ID NO: 3382 - DNA, 25 bp, Artificial Sequence
  Synthetic oligonucleotide
cuuuuuuuuaugcuucccaucuutt

SEQ ID NO: 3383 - DNA, 25 bp, Artificial Sequence
  Synthetic oligonucleotide
uuaugcuucccaucuuuuuucuutt

SEQ ID NO: 3384 - DNA, 25 bp, Artificial Sequence
  Synthetic oligonucleotide
cuucccaucuuuuuucuuuuucctt

SEQ ID NO: 3385 - DNA, 25 bp, Artificial Sequence
  Synthetic oligonucleotide
aucuuuuuucuuuuuccuuuuaaca

SEQ ID NO: 3386 - DNA, 25 bp, Artificial Sequence
  Synthetic oligonucleotide
uuuuuccuuuuaacagauuuguatt

SEQ ID NO: 3387 - DNA, 25 bp, Artificial Sequence
  Synthetic oligonucleotide
uuuuaacagauuuguauuuaauugt

SEQ ID NO: 3388 - DNA, 25 bp, Artificial Sequence
  Synthetic oligonucleotide
cagauuuguauuuaauuguuuuutt

SEQ ID NO: 3389 - DNA, 25 bp, Artificial Sequence
  Synthetic oligonucleotide
uauuuaauuguuuuuuuaaaaaaat

SEQ ID NO: 3390 - DNA, 25 bp, Artificial Sequence
  Synthetic oligonucleotide
guuuuuuuaaaaaaaucuuaaaatc

SEQ ID NO: 3391 - DNA, 25 bp, Artificial Sequence
  Synthetic oligonucleotide
uaaaaaaaucuuaaaaucuauccaa

SEQ ID NO: 3392 - DNA, 25 bp, Artificial Sequence
  Synthetic oligonucleotide
aaaucuuaaaaucuauccaauuutc

SEQ ID NO: 3393 - DNA, 25 bp, Artificial Sequence
  Synthetic oligonucleotide
aaaaucuauccaauuuucccaugta

SEQ ID NO: 3394 - DNA, 25 bp, Artificial Sequence
  Synthetic oligonucleotide
cuauccaauuuucccauguaaauag

SEQ ID NO: 3395 - DNA, 25 bp, Artificial Sequence
  Synthetic oligonucleotide
cauguaaauagggccuugaaaugta

SEQ ID NO: 3396 - DNA, 25 bp, Artificial Sequence
  Synthetic oligonucleotide
aaauagggccuugaaauguaaauaa

SEQ ID NO: 3397 - DNA, 25 bp, Artificial Sequence
  Synthetic oligonucleotide
gggccuugaaauguaaauaacuuta

SEQ ID NO: 3398 - DNA, 25 bp, Artificial Sequence
  Synthetic oligonucleotide
uugaaauguaaauaacuuuaauaaa

SEQ ID NO: 3399 - DNA, 25 bp, Artificial Sequence
  Synthetic oligonucleotide
uuuaauaaaacguuuauaacaguta

SEQ ID NO: 3400 - DNA, 25 bp, Artificial Sequence
  Synthetic oligonucleotide
uaaaacguuuauaacaguuacaaaa

SEQ ID NO: 3401 - DNA, 25 bp, Artificial Sequence
  Synthetic oligonucleotide
cguuuauaacaguuacaaaagautt

SEQ ID NO: 3402 - DNA, 25 bp, Artificial Sequence
  Synthetic oligonucleotide
caguuacaaaagauuuuaagacatg

SEQ ID NO: 3403 - DNA, 25 bp, Artificial Sequence
  Synthetic oligonucleotide
caaaagauuuuaagacauguaccat

SEQ ID NO: 3404 - DNA, 25 bp, Artificial Sequence
  Synthetic oligonucleotide
auuuuaagacauguaccauaauutt

SEQ ID NO: 3405 - DNA, 25 bp, Artificial Sequence
  Synthetic oligonucleotide
gacauguaccauaauuuuuuuuatt

SEQ ID NO: 3406 - DNA, 25 bp, Artificial Sequence
  Synthetic oligonucleotide
cauaauuuuuuuuauuuaaagacat

SEQ ID NO: 3407 - DNA, 25 bp, Artificial Sequence
  Synthetic oligonucleotide
uuuuuuuuauuuaaagacauuuuca

SEQ ID NO: 3408 - DNA, 25 bp, Artificial Sequence
  Synthetic oligonucleotide
auuuaaagacauuuucauuuuuaaa

SEQ ID NO: 3409 - DNA, 25 bp, Artificial Sequence
  Synthetic oligonucleotide
aagacauuuucauuuuuaaaguuga

SEQ ID NO: 3410 - DNA, 25 bp, Artificial Sequence
  Synthetic oligonucleotide
auuuucauuuuuaaaguugauuutt

SEQ ID NO: 3411 - DNA, 25 bp, Artificial Sequence
  Synthetic oligonucleotide
auuuuuaaaguugauuuuuuucuat

SEQ ID NO: 3412 - DNA, 25 bp, Artificial Sequence
  Synthetic oligonucleotide
uauuguuuuuagaaaaaaauaaaat

SEQ ID NO: 3413 - DNA, 25 bp, Artificial Sequence
  Synthetic oligonucleotide
uuuuagaaaaaaauaaaauaauugg

SEQ ID NO: 3414 - DNA, 25 bp, Artificial Sequence
  Synthetic oligonucleotide
aaaaaauaaaauaauuggaaaaaat

SEQ ID NO: 3415 - RNA, 27 nt, Artificial Sequence
  Synthetic oligonucleotide
ucuuuuauacugcgacucaggaucccu

SEQ ID NO: 3416 - RNA, 27 nt, Artificial Sequence
  Synthetic oligonucleotide
aaaagcuucuuuuauacugcgacucag

SEQ ID NO: 3417 - RNA, 27 nt, Artificial Sequence
  Synthetic oligonucleotide
gcccgaaaagcuucuuuuauacugcga

SEQ ID NO: 3418 - RNA, 27 nt, Artificial Sequence
  Synthetic oligonucleotide
cagaaaaaaacgcccgaaaagcuucuu

SEQ ID NO: 3419 - RNA, 27 nt, Artificial Sequence
  Synthetic oligonucleotide
uacuacagcgagucagaaaaaaacgcc

SEQ ID NO: 3420 - RNA, 27 nt, Artificial Sequence
  Synthetic oligonucleotide
ucuuccaaccguccgcucacucccucu

SEQ ID NO: 3421 - RNA, 27 nt, Artificial Sequence
  Synthetic oligonucleotide
cacacggcucuuccaaccguccgcuca

SEQ ID NO: 3422 - RNA, 27 nt, Artificial Sequence
  Synthetic oligonucleotide
cucacuccagagcugccuucuuagguc

SEQ ID NO: 3423 - RNA, 27 nt, Artificial Sequence
  Synthetic oligonucleotide
gcugauguugggucagucgcaggguug

SEQ ID NO: 3424 - RNA, 27 nt, Artificial Sequence
  Synthetic oligonucleotide
guaaguuccagugagaagugucugccc

SEQ ID NO: 3425 - RNA, 27 nt, Artificial Sequence
  Synthetic oligonucleotide
agauuguaaguuccagugagaaguguc

SEQ ID NO: 3426 - RNA, 27 nt, Artificial Sequence
  Synthetic oligonucleotide
cuggcucgcagauuguaaguuccagug

SEQ ID NO: 3427 - RNA, 27 nt, Artificial Sequence
  Synthetic oligonucleotide
aguccuguccuggcucgcagauuguaa

SEQ ID NO: 3428 - RNA, 27 nt, Artificial Sequence
  Synthetic oligonucleotide
ccuucaaacagcucgaggagcucuuuu

SEQ ID NO: 3429 - RNA, 27 nt, Artificial Sequence
  Synthetic oligonucleotide
ggaaauccagccuucaaacagcucgag

SEQ ID NO: 3430 - RNA, 27 nt, Artificial Sequence
  Synthetic oligonucleotide
cccaaaggaaauccagccuucaaacag

SEQ ID NO: 3431 - RNA, 27 nt, Artificial Sequence
  Synthetic oligonucleotide
ggguuuccaacgcccaaaggaaaucca

SEQ ID NO: 3432 - RNA, 27 nt, Artificial Sequence
  Synthetic oligonucleotide
uccuguuggugaaguucacguugaggg

SEQ ID NO: 3433 - RNA, 27 nt, Artificial Sequence
  Synthetic oligonucleotide
cauaguuccuguuggugaaguucacgu

SEQ ID NO: 3434 - RNA, 27 nt, Artificial Sequence
  Synthetic oligonucleotide
agaugaaauagggcuguacggagucgu

SEQ ID NO: 3435 - RNA, 27 nt, Artificial Sequence
  Synthetic oligonucleotide
ugauagaaauucucuuccucgucgcag

SEQ ID NO: 3436 - RNA, 27 nt, Artificial Sequence
  Synthetic oligonucleotide
guugcuggugauagaaauucucuuccu

SEQ ID NO: 3437 - RNA, 27 nt, Artificial Sequence
  Synthetic oligonucleotide
ucgaauuucuuccagauauccucacug

SEQ ID NO: 3438 - RNA, 27 nt, Artificial Sequence
  Synthetic oligonucleotide
ggugggaagcagcucgaauuucuucca

SEQ ID NO: 3439 - RNA, 27 nt, Artificial Sequence
  Synthetic oligonucleotide
caacauaggauggagagcagagcccgg

SEQ ID NO: 3440 - RNA, 27 nt, Artificial Sequence
  Synthetic oligonucleotide
gaccgcaacauaggauggagagcagag

SEQ ID NO: 3441 - RNA, 27 nt, Artificial Sequence
  Synthetic oligonucleotide
aggacguagcgaccgcaacauaggaug

SEQ ID NO: 3442 - RNA, 27 nt, Artificial Sequence
  Synthetic oligonucleotide
gggagaaggacguagcgaccgcaacau

SEQ ID NO: 3443 - RNA, 27 nt, Artificial Sequence
  Synthetic oligonucleotide
ucggucaucaucuccagcugaucggcg

SEQ ID NO: 3444 - RNA, 27 nt, Artificial Sequence
  Synthetic oligonucleotide
caaguaacucggucaucaucuccagcu

SEQ ID NO: 3445 - RNA, 27 nt, Artificial Sequence
  Synthetic oligonucleotide
gucuccuccaaguaacucggucaucau

SEQ ID NO: 3446 - RNA, 27 nt, Artificial Sequence
  Synthetic oligonucleotide
uucaccaugucuccuccaaguaacucg

SEQ ID NO: 3447 - RNA, 27 nt, Artificial Sequence
  Synthetic oligonucleotide
ucugguucaccaugucuccuccaagua

SEQ ID NO: 3448 - RNA, 27 nt, Artificial Sequence
  Synthetic oligonucleotide
gcagaugaagcucugguucaccauguc

SEQ ID NO: 3449 - RNA, 27 nt, Artificial Sequence
  Synthetic oligonucleotide
gucaggaucgcagaugaagcucugguu

SEQ ID NO: 3450 - RNA, 27 nt, Artificial Sequence
  Synthetic oligonucleotide
ucgucgucaggaucgcagaugaagcuc

SEQ ID NO: 3451 - RNA, 27 nt, Artificial Sequence
  Synthetic oligonucleotide
aaggucucgucgucaggaucgcagaug

SEQ ID NO: 3452 - RNA, 27 nt, Artificial Sequence
  Synthetic oligonucleotide
uugaugaaggucucgucgucaggaucg

SEQ ID NO: 3453 - RNA, 27 nt, Artificial Sequence
  Synthetic oligonucleotide
ugauguucuugaugaaggucucgucgu

SEQ ID NO: 3454 - RNA, 27 nt, Artificial Sequence
  Synthetic oligonucleotide
ggaugaugauguucuugaugaaggucu

SEQ ID NO: 3455 - RNA, 27 nt, Artificial Sequence
  Synthetic oligonucleotide
uacaguccuggaugaugauguucuuga

SEQ ID NO: 3456 - RNA, 27 nt, Artificial Sequence
  Synthetic oligonucleotide
ugagaaaccgcuccacauacaguccug

SEQ ID NO: 3457 - RNA, 27 nt, Artificial Sequence
  Synthetic oligonucleotide
gcagguacaggcuggagguggagcaga

SEQ ID NO: 3458 - RNA, 27 nt, Artificial Sequence
  Synthetic oligonucleotide
gguccugcagguacaggcuggaggugg

SEQ ID NO: 3459 - RNA, 27 nt, Artificial Sequence
  Synthetic oligonucleotide
cggugagguccugcagguacaggcugg

SEQ ID NO: 3460 - RNA, 27 nt, Artificial Sequence
  Synthetic oligonucleotide
gagguacaggauuugggcgagcugcug

SEQ ID NO: 3461 - RNA, 27 nt, Artificial Sequence
  Synthetic oligonucleotide
uggaaucggacgagguacaggauuugg

SEQ ID NO: 3462 - RNA, 27 nt, Artificial Sequence
  Synthetic oligonucleotide
cucuucuucagagucgcugcugguggu

SEQ ID NO: 3463 - RNA, 27 nt, Artificial Sequence
  Synthetic oligonucleotide
ucuugcucuucuucagagucgcugcug

SEQ ID NO: 3464 - RNA, 27 nt, Artificial Sequence
  Synthetic oligonucleotide
ucaucuucuugcucuucuucagagucg

SEQ ID NO: 3465 - RNA, 27 nt, Artificial Sequence
  Synthetic oligonucleotide
cuuccucaucuucuugcucuucuucag

SEQ ID NO: 3466 - RNA, 27 nt, Artificial Sequence
  Synthetic oligonucleotide
ucaauuucuuccucaucuucuugcucu

SEQ ID NO: 3467 - RNA, 27 nt, Artificial Sequence
  Synthetic oligonucleotide
accacaucaauuucuuccucaucuucu

SEQ ID NO: 3468 - RNA, 27 nt, Artificial Sequence
  Synthetic oligonucleotide
acagacaccacaucaauuucuuccuca

SEQ ID NO: 3469 - RNA, 27 nt, Artificial Sequence
  Synthetic oligonucleotide
ucuccacagacaccacaucaauuucuu

SEQ ID NO: 3470 - RNA, 27 nt, Artificial Sequence
  Synthetic oligonucleotide
gccucuucuccacagacaccacaucaa

SEQ ID NO: 3471 - RNA, 27 nt, Artificial Sequence
  Synthetic oligonucleotide
ggguuugccucuucuccacagacacca

SEQ ID NO: 3472 - RNA, 27 nt, Artificial Sequence
  Synthetic oligonucleotide
augagcccgacuccgaccucuuggcag

SEQ ID NO: 3473 - RNA, 27 nt, Artificial Sequence
  Synthetic oligonucleotide
gugaguggagacguggcaccucuugag

SEQ ID NO: 3474 - RNA, 27 nt, Artificial Sequence
  Synthetic oligonucleotide
cguaguugugcuggugaguggagacgu

SEQ ID NO: 3475 - RNA, 27 nt, Artificial Sequence
  Synthetic oligonucleotide
cacuguccaacuuggcccucuuggcag

SEQ ID NO: 3476 - RNA, 27 nt, Artificial Sequence
  Synthetic oligonucleotide
ccugccacuguccaacuuggcccucuu

SEQ ID NO: 3477 - RNA, 27 nt, Artificial Sequence
  Synthetic oligonucleotide
uucaggacccugccacuguccaacuug

SEQ ID NO: 3478 - RNA, 27 nt, Artificial Sequence
  Synthetic oligonucleotide
ucugcuucaggacccugccacugucca

SEQ ID NO: 3479 - RNA, 27 nt, Artificial Sequence
  Synthetic oligonucleotide
ugcugaucugcuucaggacccugccac

SEQ ID NO: 3480 - RNA, 27 nt, Artificial Sequence
  Synthetic oligonucleotide
gguuguugcugaucugcuucaggaccc

SEQ ID NO: 3481 - RNA, 27 nt, Artificial Sequence
  Synthetic oligonucleotide
cuugcgguuguugcugaucugcuucag

SEQ ID NO: 3482 - RNA, 27 nt, Artificial Sequence
  Synthetic oligonucleotide
ggcaaaaaagcugcgcuucagcucguu

SEQ ID NO: 3483 - RNA, 27 nt, Artificial Sequence
  Synthetic oligonucleotide
uggucacgcagggcaaaaaagcugcgc

SEQ ID NO: 3484 - RNA, 27 nt, Artificial Sequence
  Synthetic oligonucleotide
caauucagggaucuggucacgcagggc

SEQ ID NO: 3485 - RNA, 27 nt, Artificial Sequence
  Synthetic oligonucleotide
uuguuuuccaauucagggaucugguca

SEQ ID NO: 3486 - RNA, 27 nt, Artificial Sequence
  Synthetic oligonucleotide
gccuuuucguuguuuuccaauucaggg

SEQ ID NO: 3487 - RNA, 27 nt, Artificial Sequence
  Synthetic oligonucleotide
guggcuuuuuugaggaucacuaccuug

SEQ ID NO: 3488 - RNA, 27 nt, Artificial Sequence
  Synthetic oligonucleotide
caggauguaggcgguggcuuuuuugag

SEQ ID NO: 3489 - RNA, 27 nt, Artificial Sequence
  Synthetic oligonucleotide
gaauggacaggauguaggcgguggcuu

SEQ ID NO: 3490 - RNA, 27 nt, Artificial Sequence
  Synthetic oligonucleotide
ugcuugaauggacaggauguaggcggu

SEQ ID NO: 3491 - RNA, 27 nt, Artificial Sequence
  Synthetic oligonucleotide
ucgucugcuugaauggacaggauguag

SEQ ID NO: 3492 - RNA, 27 nt, Artificial Sequence
  Synthetic oligonucleotide
ugugcucgucugcuugaauggacagga

SEQ ID NO: 3493 - RNA, 27 nt, Artificial Sequence
  Synthetic oligonucleotide
ucagaggugagcuugugcucgucugcu

SEQ ID NO: 3494 - RNA, 27 nt, Artificial Sequence
  Synthetic oligonucleotide
uccuuuucagaggugagcuugugcucg

SEQ ID NO: 3495 - RNA, 27 nt, Artificial Sequence
  Synthetic oligonucleotide
ucaauaaguccuuuucagaggugagcu

SEQ ID NO: 3496 - RNA, 27 nt, Artificial Sequence
  Synthetic oligonucleotide
gucguuuccucaauaaguccuuuucag

SEQ ID NO: 3497 - RNA, 27 nt, Artificial Sequence
  Synthetic oligonucleotide
uuucaacuguucucgucguuuccucaa

SEQ ID NO: 3498 - RNA, 27 nt, Artificial Sequence
  Synthetic oligonucleotide
cagaguuucgaagcuguucgaguuugu

SEQ ID NO: 3499 - RNA, 27 nt, Artificial Sequence
  Synthetic oligonucleotide
ugcaccagaguuucgaagcuguucgag

SEQ ID NO: 3500 - RNA, 27 nt, Artificial Sequence
  Synthetic oligonucleotide
ucaguuuaugcaccagaguuucgaagc

SEQ ID NO: 3501 - RNA, 27 nt, Artificial Sequence
  Synthetic oligonucleotide
guuaggucaguuuaugcaccagaguuu

SEQ ID NO: 3502 - RNA, 27 nt, Artificial Sequence
  Synthetic oligonucleotide
ccucgaguuaggucaguuuaugcacca

SEQ ID NO: 3503 - RNA, 27 nt, Artificial Sequence
  Synthetic oligonucleotide
cucacgagagauuccagcuccuccucg

SEQ ID NO: 3504 - RNA, 27 nt, Artificial Sequence
  Synthetic oligonucleotide
ucuccuuacucucacgagagauuccag

SEQ ID NO: 3505 - RNA, 27 nt, Artificial Sequence
  Synthetic oligonucleotide
gaaccguucuccuuacucucacgagag

SEQ ID NO: 3506 - RNA, 27 nt, Artificial Sequence
  Synthetic oligonucleotide
ugucagaaggaaccguucuccuuacuc

SEQ ID NO: 3507 - RNA, 27 nt, Artificial Sequence
  Synthetic oligonucleotide
aguucugucagaaggaaccguucuccu

SEQ ID NO: 3508 - RNA, 27 nt, Artificial Sequence
  Synthetic oligonucleotide
gcaucaguucugucagaaggaaccguu

SEQ ID NO: 3509 - RNA, 27 nt, Artificial Sequence
  Synthetic oligonucleotide
uuuuaauuccagcgcaucaguucuguc

SEQ ID NO: 3510 - RNA, 27 nt, Artificial Sequence
  Synthetic oligonucleotide
augcauuuuaauuccagcgcaucaguu

SEQ ID NO: 3511 - RNA, 27 nt, Artificial Sequence
  Synthetic oligonucleotide
ugagcaugcauuuuaauuccagcgcau

SEQ ID NO: 3512 - RNA, 27 nt, Artificial Sequence
  Synthetic oligonucleotide
ggcuuugagcaugcauuuuaauuccag

SEQ ID NO: 3513 - RNA, 27 nt, Artificial Sequence
  Synthetic oligonucleotide
gagguuaggcuuugagcaugcauuuua

SEQ ID NO: 3514 - RNA, 27 nt, Artificial Sequence
  Synthetic oligonucleotide
aagguugugagguuaggcuuugagcau

SEQ ID NO: 3515 - RNA, 27 nt, Artificial Sequence
  Synthetic oligonucleotide
cagccaagguugugagguuaggcuuug

SEQ ID NO: 3516 - RNA, 27 nt, Artificial Sequence
  Synthetic oligonucleotide
uggcugaagcuuacagucccaaagccc

SEQ ID NO: 3517 - RNA, 27 nt, Artificial Sequence
  Synthetic oligonucleotide
aaaauuauggcugaagcuuacaguccc

SEQ ID NO: 3518 - RNA, 27 nt, Artificial Sequence
  Synthetic oligonucleotide
ggcaguuaaaauuauggcugaagcuua

SEQ ID NO: 3519 - RNA, 27 nt, Artificial Sequence
  Synthetic oligonucleotide
aguuugaggcaguuaaaauuauggcug

SEQ ID NO: 3520 - RNA, 27 nt, Artificial Sequence
  Synthetic oligonucleotide
acuauuuaaguuugaggcaguuaaaau

SEQ ID NO: 3521 - RNA, 27 nt, Artificial Sequence
  Synthetic oligonucleotide
uuuuauacuauuuaaguuugaggcagu

SEQ ID NO: 3522 - RNA, 27 nt, Artificial Sequence
  Synthetic oligonucleotide
aguucuuuuauacuauuuaaguuugag

SEQ ID NO: 3523 - RNA, 27 nt, Artificial Sequence
  Synthetic oligonucleotide
aaaaaaaaguucuuuuauacuauuuaa

SEQ ID NO: 3524 - RNA, 27 nt, Artificial Sequence
  Synthetic oligonucleotide
aagcauaaaaaaaaguucuuuuauacu

SEQ ID NO: 3525 - RNA, 27 nt, Artificial Sequence
  Synthetic oligonucleotide
augggaagcauaaaaaaaaguucuuuu

SEQ ID NO: 3526 - RNA, 27 nt, Artificial Sequence
  Synthetic oligonucleotide
aaaagaugggaagcauaaaaaaaaguu

SEQ ID NO: 3527 - RNA, 27 nt, Artificial Sequence
  Synthetic oligonucleotide
aaaagaaaaaagaugggaagcauaaaa

SEQ ID NO: 3528 - RNA, 27 nt, Artificial Sequence
  Synthetic oligonucleotide
aaggaaaaagaaaaaagaugggaagca

SEQ ID NO: 3529 - RNA, 27 nt, Artificial Sequence
  Synthetic oligonucleotide
uguuaaaaggaaaaagaaaaaagaugg

SEQ ID NO: 3530 - RNA, 27 nt, Artificial Sequence
  Synthetic oligonucleotide
aauacaaaucuguuaaaaggaaaaaga

SEQ ID NO: 3531 - RNA, 27 nt, Artificial Sequence
  Synthetic oligonucleotide
acaauuaaauacaaaucuguuaaaagg

SEQ ID NO: 3532 - RNA, 27 nt, Artificial Sequence
  Synthetic oligonucleotide
aaaaaaacaauuaaauacaaaucuguu

SEQ ID NO: 3533 - RNA, 27 nt, Artificial Sequence
  Synthetic oligonucleotide
auuuuuuuaaaaaaacaauuaaauaca

SEQ ID NO: 3534 - RNA, 27 nt, Artificial Sequence
  Synthetic oligonucleotide
gauuuuaagauuuuuuuaaaaaaacaa

SEQ ID NO: 3535 - RNA, 27 nt, Artificial Sequence
  Synthetic oligonucleotide
uuggauagauuuuaagauuuuuuuaaa

SEQ ID NO: 3536 - RNA, 27 nt, Artificial Sequence
  Synthetic oligonucleotide
gaaaauuggauagauuuuaagauuuuu

SEQ ID NO: 3537 - RNA, 27 nt, Artificial Sequence
  Synthetic oligonucleotide
uacaugggaaaauuggauagauuuuaa

SEQ ID NO: 3538 - RNA, 27 nt, Artificial Sequence
  Synthetic oligonucleotide
cuauuuacaugggaaaauuggauagau

SEQ ID NO: 3539 - RNA, 27 nt, Artificial Sequence
  Synthetic oligonucleotide
uacauuucaaggcccuauuuacauggg

SEQ ID NO: 3540 - RNA, 27 nt, Artificial Sequence
  Synthetic oligonucleotide
uuauuuacauuucaaggcccuauuuac

SEQ ID NO: 3541 - RNA, 27 nt, Artificial Sequence
  Synthetic oligonucleotide
uaaaguuauuuacauuucaaggcccua

SEQ ID NO: 3542 - RNA, 27 nt, Artificial Sequence
  Synthetic oligonucleotide
uuuauuaaaguuauuuacauuucaagg

SEQ ID NO: 3543 - RNA, 27 nt, Artificial Sequence
  Synthetic oligonucleotide
uaacuguuauaaacguuuuauuaaagu

SEQ ID NO: 3544 - RNA, 27 nt, Artificial Sequence
  Synthetic oligonucleotide
uuuuguaacuguuauaaacguuuuauu

SEQ ID NO: 3545 - RNA, 27 nt, Artificial Sequence
  Synthetic oligonucleotide
aaaucuuuuguaacuguuauaaacguu

SEQ ID NO: 3546 - RNA, 27 nt, Artificial Sequence
  Synthetic oligonucleotide
caugucuuaaaaucuuuuguaacuguu

SEQ ID NO: 3547 - RNA, 27 nt, Artificial Sequence
  Synthetic oligonucleotide
augguacaugucuuaaaaucuuuugua

SEQ ID NO: 3548 - RNA, 27 nt, Artificial Sequence
  Synthetic oligonucleotide
aaaauuaugguacaugucuuaaaaucu

SEQ ID NO: 3549 - RNA, 27 nt, Artificial Sequence
  Synthetic oligonucleotide
aauaaaaaaaauuaugguacaugucuu

SEQ ID NO: 3550 - RNA, 27 nt, Artificial Sequence
  Synthetic oligonucleotide
augucuuuaaauaaaaaaaauuauggu

SEQ ID NO: 3551 - RNA, 27 nt, Artificial Sequence
  Synthetic oligonucleotide
ugaaaaugucuuuaaauaaaaaaaauu

SEQ ID NO: 3552 - RNA, 27 nt, Artificial Sequence
  Synthetic oligonucleotide
uuuaaaaaugaaaaugucuuuaaauaa

SEQ ID NO: 3553 - RNA, 27 nt, Artificial Sequence
  Synthetic oligonucleotide
ucaacuuuaaaaaugaaaaugucuuua

SEQ ID NO: 3554 - RNA, 27 nt, Artificial Sequence
  Synthetic oligonucleotide
aaaaaucaacuuuaaaaaugaaaaugu

SEQ ID NO: 3555 - RNA, 27 nt, Artificial Sequence
  Synthetic oligonucleotide
auagaaaaaaaucaacuuuaaaaauga

SEQ ID NO: 3556 - RNA, 27 nt, Artificial Sequence
  Synthetic oligonucleotide
auuuuauuuuuuucuaaaaacaauaga

SEQ ID NO: 3557 - RNA, 27 nt, Artificial Sequence
  Synthetic oligonucleotide
ccaauuauuuuauuuuuuucuaaaaac

SEQ ID NO: 3558 - RNA, 27 nt, Artificial Sequence
  Synthetic oligonucleotide
auuuuuuccaauuauuuuauuuuuuuc

SEQ ID NO: 3559 - DNA, 27 bp, Artificial Sequence
  Synthetic oligonucleotide
agggatcctgagtcgcagtataaaaga

SEQ ID NO: 3560 - DNA, 27 bp, Artificial Sequence
  Synthetic oligonucleotide
ctgagtcgcagtataaaagaagctttt

SEQ ID NO: 3561 - DNA, 27 bp, Artificial Sequence
  Synthetic oligonucleotide
tcgcagtataaaagaagcttttcgggc

SEQ ID NO: 3562 - DNA, 27 bp, Artificial Sequence
  Synthetic oligonucleotide
aagaagcttttcgggcgtttttttctg

SEQ ID NO: 3563 - DNA, 27 bp, Artificial Sequence
  Synthetic oligonucleotide
ggcgtttttttctgactcgctgtagta

SEQ ID NO: 3564 - DNA, 27 bp, Artificial Sequence
  Synthetic oligonucleotide
agagggagtgagcggacggttggaaga

SEQ ID NO: 3565 - DNA, 27 bp, Artificial Sequence
  Synthetic oligonucleotide
tgagcggacggttggaagagccgtgtg

SEQ ID NO: 3566 - DNA, 27 bp, Artificial Sequence
  Synthetic oligonucleotide
gacctaagaaggcagctctggagtgag

SEQ ID NO: 3567 - DNA, 27 bp, Artificial Sequence
  Synthetic oligonucleotide
caaccctgcgactgacccaacatcagc

SEQ ID NO: 3568 - DNA, 27 bp, Artificial Sequence
  Synthetic oligonucleotide
gggcagacacttctcactggaacttac

SEQ ID NO: 3569 - DNA, 27 bp, Artificial Sequence
  Synthetic oligonucleotide
gacacttctcactggaacttacaatct

SEQ ID NO: 3570 - DNA, 27 bp, Artificial Sequence
  Synthetic oligonucleotide
cactggaacttacaatctgcgagccag

SEQ ID NO: 3571 - DNA, 27 bp, Artificial Sequence
  Synthetic oligonucleotide
ttacaatctgcgagccaggacaggact

SEQ ID NO: 3572 - DNA, 27 bp, Artificial Sequence
  Synthetic oligonucleotide
aaaagagctcctcgagctgtttgaagg

SEQ ID NO: 3573 - DNA, 27 bp, Artificial Sequence
  Synthetic oligonucleotide
ctcgagctgtttgaaggctggatttcc

SEQ ID NO: 3574 - DNA, 27 bp, Artificial Sequence
  Synthetic oligonucleotide
ctgtttgaaggctggatttcctttggg

SEQ ID NO: 3575 - DNA, 27 bp, Artificial Sequence
  Synthetic oligonucleotide
tggatttcctttgggcgttggaaaccc

SEQ ID NO: 3576 - DNA, 27 bp, Artificial Sequence
  Synthetic oligonucleotide
ccctcaacgtgaacttcaccaacagga

SEQ ID NO: 3577 - DNA, 27 bp, Artificial Sequence
  Synthetic oligonucleotide
acgtgaacttcaccaacaggaactatg

SEQ ID NO: 3578 - DNA, 27 bp, Artificial Sequence
  Synthetic oligonucleotide
acgactccgtacagccctatttcatct

SEQ ID NO: 3579 - DNA, 27 bp, Artificial Sequence
  Synthetic oligonucleotide
ctgcgacgaggaagagaatttctatca

SEQ ID NO: 3580 - DNA, 27 bp, Artificial Sequence
  Synthetic oligonucleotide
aggaagagaatttctatcaccagcaac

SEQ ID NO: 3581 - DNA, 27 bp, Artificial Sequence
  Synthetic oligonucleotide
cagtgaggatatctggaagaaattcga

SEQ ID NO: 3582 - DNA, 27 bp, Artificial Sequence
  Synthetic oligonucleotide
tggaagaaattcgagctgcttcccacc

SEQ ID NO: 3583 - DNA, 27 bp, Artificial Sequence
  Synthetic oligonucleotide
ccgggctctgctctccatcctatgttg

SEQ ID NO: 3584 - DNA, 27 bp, Artificial Sequence
  Synthetic oligonucleotide
ctctgctctccatcctatgttgcggtc

SEQ ID NO: 3585 - DNA, 27 bp, Artificial Sequence
  Synthetic oligonucleotide
catcctatgttgcggtcgctacgtcct

SEQ ID NO: 3586 - DNA, 27 bp, Artificial Sequence
  Synthetic oligonucleotide
atgttgcggtcgctacgtccttctccc

SEQ ID NO: 3587 - DNA, 27 bp, Artificial Sequence
  Synthetic oligonucleotide
cgccgatcagctggagatgatgaccga

SEQ ID NO: 3588 - DNA, 27 bp, Artificial Sequence
  Synthetic oligonucleotide
agctggagatgatgaccgagttacttg

SEQ ID NO: 3589 - DNA, 27 bp, Artificial Sequence
  Synthetic oligonucleotide
atgatgaccgagttacttggaggagac

SEQ ID NO: 3590 - DNA, 27 bp, Artificial Sequence
  Synthetic oligonucleotide
cgagttacttggaggagacatggtgaa

SEQ ID NO: 3591 - DNA, 27 bp, Artificial Sequence
  Synthetic oligonucleotide
tacttggaggagacatggtgaaccaga

SEQ ID NO: 3592 - DNA, 27 bp, Artificial Sequence
  Synthetic oligonucleotide
gacatggtgaaccagagcttcatctgc

SEQ ID NO: 3593 - DNA, 27 bp, Artificial Sequence
  Synthetic oligonucleotide
aaccagagcttcatctgcgatcctgac

SEQ ID NO: 3594 - DNA, 27 bp, Artificial Sequence
  Synthetic oligonucleotide
gagcttcatctgcgatcctgacgacga

SEQ ID NO: 3595 - DNA, 27 bp, Artificial Sequence
  Synthetic oligonucleotide
catctgcgatcctgacgacgagacctt

SEQ ID NO: 3596 - DNA, 27 bp, Artificial Sequence
  Synthetic oligonucleotide
cgatcctgacgacgagaccttcatcaa

SEQ ID NO: 3597 - DNA, 27 bp, Artificial Sequence
  Synthetic oligonucleotide
acgacgagaccttcatcaagaacatca

SEQ ID NO: 3598 - DNA, 27 bp, Artificial Sequence
  Synthetic oligonucleotide
agaccttcatcaagaacatcatcatcc

SEQ ID NO: 3599 - DNA, 27 bp, Artificial Sequence
  Synthetic oligonucleotide
tcaagaacatcatcatccaggactgta

SEQ ID NO: 3600 - DNA, 27 bp, Artificial Sequence
  Synthetic oligonucleotide
caggactgtatgtggagcggtttctca

SEQ ID NO: 3601 - DNA, 27 bp, Artificial Sequence
  Synthetic oligonucleotide
tctgctccacctccagcctgtacctgc

SEQ ID NO: 3602 - DNA, 27 bp, Artificial Sequence
  Synthetic oligonucleotide
ccacctccagcctgtacctgcaggacc

SEQ ID NO: 3603 - DNA, 27 bp, Artificial Sequence
  Synthetic oligonucleotide
ccagcctgtacctgcaggacctcaccg

SEQ ID NO: 3604 - DNA, 27 bp, Artificial Sequence
  Synthetic oligonucleotide
cagcagctcgcccaaatcctgtacctc

SEQ ID NO: 3605 - DNA, 27 bp, Artificial Sequence
  Synthetic oligonucleotide
ccaaatcctgtacctcgtccgattcca

SEQ ID NO: 3606 - DNA, 27 bp, Artificial Sequence
  Synthetic oligonucleotide
accaccagcagcgactctgaagaagag

SEQ ID NO: 3607 - DNA, 27 bp, Artificial Sequence
  Synthetic oligonucleotide
cagcagcgactctgaagaagagcaaga

SEQ ID NO: 3608 - DNA, 27 bp, Artificial Sequence
  Synthetic oligonucleotide
cgactctgaagaagagcaagaagatga

SEQ ID NO: 3609 - DNA, 27 bp, Artificial Sequence
  Synthetic oligonucleotide
ctgaagaagagcaagaagatgaggaag

SEQ ID NO: 3610 - DNA, 27 bp, Artificial Sequence
  Synthetic oligonucleotide
agagcaagaagatgaggaagaaattga

SEQ ID NO: 3611 - DNA, 27 bp, Artificial Sequence
  Synthetic oligonucleotide
agaagatgaggaagaaattgatgtggt

SEQ ID NO: 3612 - DNA, 27 bp, Artificial Sequence
  Synthetic oligonucleotide
tgaggaagaaattgatgtggtgtctgt

SEQ ID NO: 3613 - DNA, 27 bp, Artificial Sequence
  Synthetic oligonucleotide
aagaaattgatgtggtgtctgtggaga

SEQ ID NO: 3614 - DNA, 27 bp, Artificial Sequence
  Synthetic oligonucleotide
ttgatgtggtgtctgtggagaagaggc

SEQ ID NO: 3615 - DNA, 27 bp, Artificial Sequence
  Synthetic oligonucleotide
tggtgtctgtggagaagaggcaaaccc

SEQ ID NO: 3616 - DNA, 27 bp, Artificial Sequence
  Synthetic oligonucleotide
ctgccaagaggtcggagtcgggctcat

SEQ ID NO: 3617 - DNA, 27 bp, Artificial Sequence
  Synthetic oligonucleotide
ctcaagaggtgccacgtctccactcac

SEQ ID NO: 3618 - DNA, 27 bp, Artificial Sequence
  Synthetic oligonucleotide
acgtctccactcaccagcacaactacg

SEQ ID NO: 3619 - DNA, 27 bp, Artificial Sequence
  Synthetic oligonucleotide
ctgccaagagggccaagttggacagtg

SEQ ID NO: 3620 - DNA, 27 bp, Artificial Sequence
  Synthetic oligonucleotide
aagagggccaagttggacagtggcagg

SEQ ID NO: 3621 - DNA, 27 bp, Artificial Sequence
  Synthetic oligonucleotide
caagttggacagtggcagggtcctgaa

SEQ ID NO: 3622 - DNA, 27 bp, Artificial Sequence
  Synthetic oligonucleotide
tggacagtggcagggtcctgaagcaga

SEQ ID NO: 3623 - DNA, 27 bp, Artificial Sequence
  Synthetic oligonucleotide
gtggcagggtcctgaagcagatcagca

SEQ ID NO: 3624 - DNA, 27 bp, Artificial Sequence
  Synthetic oligonucleotide
gggtcctgaagcagatcagcaacaacc

SEQ ID NO: 3625 - DNA, 27 bp, Artificial Sequence
  Synthetic oligonucleotide
ctgaagcagatcagcaacaaccgcaag

SEQ ID NO: 3626 - DNA, 27 bp, Artificial Sequence
  Synthetic oligonucleotide
aacgagctgaagcgcagcttttttgcc

SEQ ID NO: 3627 - DNA, 27 bp, Artificial Sequence
  Synthetic oligonucleotide
gcgcagcttttttgccctgcgtgacca

SEQ ID NO: 3628 - DNA, 27 bp, Artificial Sequence
  Synthetic oligonucleotide
gccctgcgtgaccagatccctgaattg

SEQ ID NO: 3629 - DNA, 27 bp, Artificial Sequence
  Synthetic oligonucleotide
tgaccagatccctgaattggaaaacaa

SEQ ID NO: 3630 - DNA, 27 bp, Artificial Sequence
  Synthetic oligonucleotide
ccctgaattggaaaacaacgaaaaggc

SEQ ID NO: 3631 - DNA, 27 bp, Artificial Sequence
  Synthetic oligonucleotide
caaggtagtgatcctcaaaaaagccac

SEQ ID NO: 3632 - DNA, 27 bp, Artificial Sequence
  Synthetic oligonucleotide
ctcaaaaaagccaccgcctacatcctg

SEQ ID NO: 3633 - DNA, 27 bp, Artificial Sequence
  Synthetic oligonucleotide
aagccaccgcctacatcctgtccattc

SEQ ID NO: 3634 - DNA, 27 bp, Artificial Sequence
  Synthetic oligonucleotide
accgcctacatcctgtccattcaagca

SEQ ID NO: 3635 - DNA, 27 bp, Artificial Sequence
  Synthetic oligonucleotide
ctacatcctgtccattcaagcagacga

SEQ ID NO: 3636 - DNA, 27 bp, Artificial Sequence
  Synthetic oligonucleotide
tcctgtccattcaagcagacgagcaca

SEQ ID NO: 3637 - DNA, 27 bp, Artificial Sequence
  Synthetic oligonucleotide
agcagacgagcacaagctcacctctga

SEQ ID NO: 3638 - DNA, 27 bp, Artificial Sequence
  Synthetic oligonucleotide
cgagcacaagctcacctctgaaaagga

SEQ ID NO: 3639 - DNA, 27 bp, Artificial Sequence
  Synthetic oligonucleotide
agctcacctctgaaaaggacttattga

SEQ ID NO: 3640 - DNA, 27 bp, Artificial Sequence
  Synthetic oligonucleotide
ctgaaaaggacttattgaggaaacgac

SEQ ID NO: 3641 - DNA, 27 bp, Artificial Sequence
  Synthetic oligonucleotide
ttgaggaaacgacgagaacagttgaaa

SEQ ID NO: 3642 - DNA, 27 bp, Artificial Sequence
  Synthetic oligonucleotide
acaaactcgaacagcttcgaaactctg

SEQ ID NO: 3643 - DNA, 27 bp, Artificial Sequence
  Synthetic oligonucleotide
ctcgaacagcttcgaaactctggtgca

SEQ ID NO: 3644 - DNA, 27 bp, Artificial Sequence
  Synthetic oligonucleotide
gcttcgaaactctggtgcataaactga

SEQ ID NO: 3645 - DNA, 27 bp, Artificial Sequence
  Synthetic oligonucleotide
aaactctggtgcataaactgacctaac

SEQ ID NO: 3646 - DNA, 27 bp, Artificial Sequence
  Synthetic oligonucleotide
tggtgcataaactgacctaactcgagg

SEQ ID NO: 3647 - DNA, 27 bp, Artificial Sequence
  Synthetic oligonucleotide
cgaggaggagctggaatctctcgtgag

SEQ ID NO: 3648 - DNA, 27 bp, Artificial Sequence
  Synthetic oligonucleotide
ctggaatctctcgtgagagtaaggaga

SEQ ID NO: 3649 - DNA, 27 bp, Artificial Sequence
  Synthetic oligonucleotide
ctctcgtgagagtaaggagaacggttc

SEQ ID NO: 3650 - DNA, 27 bp, Artificial Sequence
  Synthetic oligonucleotide
gagtaaggagaacggttccttctgaca

SEQ ID NO: 3651 - DNA, 27 bp, Artificial Sequence
  Synthetic oligonucleotide
aggagaacggttccttctgacagaact

SEQ ID NO: 3652 - DNA, 27 bp, Artificial Sequence
  Synthetic oligonucleotide
aacggttccttctgacagaactgatgc

SEQ ID NO: 3653 - DNA, 27 bp, Artificial Sequence
  Synthetic oligonucleotide
gacagaactgatgcgctggaattaaaa

SEQ ID NO: 3654 - DNA, 27 bp, Artificial Sequence
  Synthetic oligonucleotide
aactgatgcgctggaattaaaatgcat

SEQ ID NO: 3655 - DNA, 27 bp, Artificial Sequence
  Synthetic oligonucleotide
atgcgctggaattaaaatgcatgctca

SEQ ID NO: 3656 - DNA, 27 bp, Artificial Sequence
  Synthetic oligonucleotide
ctggaattaaaatgcatgctcaaagcc

SEQ ID NO: 3657 - DNA, 27 bp, Artificial Sequence
  Synthetic oligonucleotide
taaaatgcatgctcaaagcctaacctc

SEQ ID NO: 3658 - DNA, 27 bp, Artificial Sequence
  Synthetic oligonucleotide
atgctcaaagcctaacctcacaacctt

SEQ ID NO: 3659 - DNA, 27 bp, Artificial Sequence
  Synthetic oligonucleotide
caaagcctaacctcacaaccttggctg

SEQ ID NO: 3660 - DNA, 27 bp, Artificial Sequence
  Synthetic oligonucleotide
gggctttgggactgtaagcttcagcca

SEQ ID NO: 3661 - DNA, 27 bp, Artificial Sequence
  Synthetic oligonucleotide
gggactgtaagcttcagccataatttt

SEQ ID NO: 3662 - DNA, 27 bp, Artificial Sequence
  Synthetic oligonucleotide
taagcttcagccataattttaactgcc

SEQ ID NO: 3663 - DNA, 27 bp, Artificial Sequence
  Synthetic oligonucleotide
cagccataattttaactgcctcaaact

SEQ ID NO: 3664 - DNA, 27 bp, Artificial Sequence
  Synthetic oligonucleotide
attttaactgcctcaaacttaaatagt

SEQ ID NO: 3665 - DNA, 27 bp, Artificial Sequence
  Synthetic oligonucleotide
actgcctcaaacttaaatagtataaaa

SEQ ID NO: 3666 - DNA, 27 bp, Artificial Sequence
  Synthetic oligonucleotide
ctcaaacttaaatagtataaaagaact

SEQ ID NO: 3667 - DNA, 27 bp, Artificial Sequence
  Synthetic oligonucleotide
ttaaatagtataaaagaactttttttt

SEQ ID NO: 3668 - DNA, 27 bp, Artificial Sequence
  Synthetic oligonucleotide
agtataaaagaacttttttttatgctt

SEQ ID NO: 3669 - DNA, 27 bp, Artificial Sequence
  Synthetic oligonucleotide
aaaagaacttttttttatgcttcccat

SEQ ID NO: 3670 - DNA, 27 bp, Artificial Sequence
  Synthetic oligonucleotide
aacttttttttatgcttcccatctttt

SEQ ID NO: 3671 - DNA, 27 bp, Artificial Sequence
  Synthetic oligonucleotide
ttttatgcttcccatcttttttctttt

SEQ ID NO: 3672 - DNA, 27 bp, Artificial Sequence
  Synthetic oligonucleotide
tgcttcccatcttttttctttttcctt

SEQ ID NO: 3673 - DNA, 27 bp, Artificial Sequence
  Synthetic oligonucleotide
ccatcttttttctttttccttttaaca

SEQ ID NO: 3674 - DNA, 27 bp, Artificial Sequence
  Synthetic oligonucleotide
tctttttccttttaacagatttgtatt

SEQ ID NO: 3675 - DNA, 27 bp, Artificial Sequence
  Synthetic oligonucleotide
ccttttaacagatttgtatttaattgt

SEQ ID NO: 3676 - DNA, 27 bp, Artificial Sequence
  Synthetic oligonucleotide
aacagatttgtatttaattgttttttt

SEQ ID NO: 3677 - DNA, 27 bp, Artificial Sequence
  Synthetic oligonucleotide
tgtatttaattgtttttttaaaaaaat

SEQ ID NO: 3678 - DNA, 27 bp, Artificial Sequence
  Synthetic oligonucleotide
ttgtttttttaaaaaaatcttaaaatc

SEQ ID NO: 3679 - DNA, 27 bp, Artificial Sequence
  Synthetic oligonucleotide
tttaaaaaaatcttaaaatctatccaa

SEQ ID NO: 3680 - DNA, 27 bp, Artificial Sequence
  Synthetic oligonucleotide
aaaaatcttaaaatctatccaattttc

SEQ ID NO: 3681 - DNA, 27 bp, Artificial Sequence
  Synthetic oligonucleotide
ttaaaatctatccaattttcccatgta

SEQ ID NO: 3682 - DNA, 27 bp, Artificial Sequence
  Synthetic oligonucleotide
atctatccaattttcccatgtaaatag

SEQ ID NO: 3683 - DNA, 27 bp, Artificial Sequence
  Synthetic oligonucleotide
cccatgtaaatagggccttgaaatgta

SEQ ID NO: 3684 - DNA, 27 bp, Artificial Sequence
  Synthetic oligonucleotide
gtaaatagggccttgaaatgtaaataa

SEQ ID NO: 3685 - DNA, 27 bp, Artificial Sequence
  Synthetic oligonucleotide
tagggccttgaaatgtaaataacttta

SEQ ID NO: 3686 - DNA, 27 bp, Artificial Sequence
  Synthetic oligonucleotide
ccttgaaatgtaaataactttaataaa

SEQ ID NO: 3687 - DNA, 27 bp, Artificial Sequence
  Synthetic oligonucleotide
actttaataaaacgtttataacagtta

SEQ ID NO: 3688 - DNA, 27 bp, Artificial Sequence
  Synthetic oligonucleotide
aataaaacgtttataacagttacaaaa

SEQ ID NO: 3689 - DNA, 27 bp, Artificial Sequence
  Synthetic oligonucleotide
aacgtttataacagttacaaaagattt

SEQ ID NO: 3690 - DNA, 27 bp, Artificial Sequence
  Synthetic oligonucleotide
aacagttacaaaagattttaagacatg

SEQ ID NO: 3691 - DNA, 27 bp, Artificial Sequence
  Synthetic oligonucleotide
tacaaaagattttaagacatgtaccat

SEQ ID NO: 3692 - DNA, 27 bp, Artificial Sequence
  Synthetic oligonucleotide
agattttaagacatgtaccataatttt

SEQ ID NO: 3693 - DNA, 27 bp, Artificial Sequence
  Synthetic oligonucleotide
aagacatgtaccataattttttttatt

SEQ ID NO: 3694 - DNA, 27 bp, Artificial Sequence
  Synthetic oligonucleotide
accataattttttttatttaaagacat

SEQ ID NO: 3695 - DNA, 27 bp, Artificial Sequence
  Synthetic oligonucleotide
aattttttttatttaaagacattttca

SEQ ID NO: 3696 - DNA, 27 bp, Artificial Sequence
  Synthetic oligonucleotide
ttatttaaagacattttcatttttaaa

SEQ ID NO: 3697 - DNA, 27 bp, Artificial Sequence
  Synthetic oligonucleotide
taaagacattttcatttttaaagttga

SEQ ID NO: 3698 - DNA, 27 bp, Artificial Sequence
  Synthetic oligonucleotide
acattttcatttttaaagttgattttt

SEQ ID NO: 3699 - DNA, 27 bp, Artificial Sequence
  Synthetic oligonucleotide
tcatttttaaagttgatttttttctat

SEQ ID NO: 3700 - DNA, 27 bp, Artificial Sequence
  Synthetic oligonucleotide
tctattgtttttagaaaaaaataaaat

SEQ ID NO: 3701 - DNA, 27 bp, Artificial Sequence
  Synthetic oligonucleotide
gtttttagaaaaaaataaaataattgg

SEQ ID NO: 3702 - DNA, 27 bp, Artificial Sequence
  Synthetic oligonucleotide
gaaaaaaataaaataattggaaaaaat

SEQ ID NO: 3703 - RNA, 21 nt, Artificial Sequence
  Synthetic oligonucleotide
uugaugaaggucucgucgucc

SEQ ID NO: 3704 - RNA, 21 nt, Artificial Sequence
  Synthetic oligonucleotide
acgacgagaccuucaucaaaa

SEQ ID NO: 3705 - RNA, 21 nt, Artificial Sequence
  Synthetic oligonucleotide
ggacgacgagaccuucaucaa

SEQ ID NO: 3706 - RNA, 21 nt, Artificial Sequence
  Synthetic oligonucleotide
ggacgacgagaccuucauccc

SEQ ID NO: 3707 - DNA, 25 bp, Artificial Sequence
  Synthetic oligonucleotide
aggaacuaugaccucgacaacgact

SEQ ID NO: 3708 - DNA, 25 bp, Artificial Sequence
  Synthetic oligonucleotide
aggaacuaugaccucgacuucgact

SEQ ID NO: 3709 - DNA, 25 bp, Artificial Sequence
  Synthetic oligonucleotide
aggaacuaugaccucgacuaagact

SEQ ID NO: 3710 - DNA, 25 bp, Artificial Sequence
  Synthetic oligonucleotide
aggaacuaugaccucgacuacuact

SEQ ID NO: 3711 - DNA, 25 bp, Artificial Sequence
  Synthetic oligonucleotide
aggaacuaugaccucgacuacguct

SEQ ID NO: 3712 - DNA, 25 bp, Artificial Sequence
  Synthetic oligonucleotide
aggaacuaugaccucgacuacgatt

SEQ ID NO: 3713 - DNA, 25 bp, Artificial Sequence
  Synthetic oligonucleotide
aggaacuaugaccucgacuacgaca

SEQ ID NO: 3714 - RNA, 27 nt, Artificial Sequence
  Synthetic oligonucleotide
ugucguagucgaggucauaguuccugu

SEQ ID NO: 3715 - RNA, 27 nt, Artificial Sequence
  Synthetic oligonucleotide
aaucguagucgaggucauaguuccugu

SEQ ID NO: 3716 - RNA, 27 nt, Artificial Sequence
  Synthetic oligonucleotide
agacguagucgaggucauaguuccugu

SEQ ID NO: 3717 - RNA, 27 nt, Artificial Sequence
  Synthetic oligonucleotide
aguaguagucgaggucauaguuccugu

SEQ ID NO: 3718 - RNA, 27 nt, Artificial Sequence
  Synthetic oligonucleotide
agucuuagucgaggucauaguuccugu

SEQ ID NO: 3719 - RNA, 27 nt, Artificial Sequence
  Synthetic oligonucleotide
agucgaagucgaggucauaguuccugu

SEQ ID NO: 3720 - RNA, 27 nt, Artificial Sequence
  Synthetic oligonucleotide
agucguugucgaggucauaguuccugu

SEQ ID NO: 3721 - DNA, 25 bp, Artificial Sequence
  Synthetic oligonucleotide
acgacgagaccuucaucauaaacat

SEQ ID NO: 3722 - DNA, 25 bp, Artificial Sequence
  Synthetic oligonucleotide
acgacgagaccuucaucaauaacat

SEQ ID NO: 3723 - DNA, 25 bp, Artificial Sequence
  Synthetic oligonucleotide
acgacgagaccuucaucaaauacat

SEQ ID NO: 3724 - DNA, 25 bp, Artificial Sequence
  Synthetic oligonucleotide
acgacgagaccuucaucaaaagcat

SEQ ID NO: 3725 - DNA, 25 bp, Artificial Sequence
  Synthetic oligonucleotide
acgacgagaccuucaucaaaaaaat

SEQ ID NO: 3726 - DNA, 25 bp, Artificial Sequence
  Synthetic oligonucleotide
acgacgagaccuucaucaaaaacgt

SEQ ID NO: 3727 - DNA, 25 bp, Artificial Sequence
  Synthetic oligonucleotide
acgacgagaccuucaucaaaaacaa

SEQ ID NO: 3728 - RNA, 27 nt, Artificial Sequence
  Synthetic oligonucleotide
uuguuuuugaugaaggucucgucgucc

SEQ ID NO: 3729 - RNA, 27 nt, Artificial Sequence
  Synthetic oligonucleotide
acguuuuugaugaaggucucgucgucc

SEQ ID NO: 3730 - RNA, 27 nt, Artificial Sequence
  Synthetic oligonucleotide
auuuuuuugaugaaggucucgucgucc

SEQ ID NO: 3731 - RNA, 27 nt, Artificial Sequence
  Synthetic oligonucleotide
augcuuuugaugaaggucucgucgucc

SEQ ID NO: 3732 - RNA, 27 nt, Artificial Sequence
  Synthetic oligonucleotide
auguauuugaugaaggucucgucgucc

SEQ ID NO: 3733 - RNA, 27 nt, Artificial Sequence
  Synthetic oligonucleotide
auguuauugaugaaggucucgucgucc

SEQ ID NO: 3734 - RNA, 27 nt, Artificial Sequence
  Synthetic oligonucleotide
auguuuaugaugaaggucucgucgucc

SEQ ID NO: 3735 - DNA, 25 bp, Artificial Sequence
  Synthetic oligonucleotide
aagaugaggaagaaaucguuguugt

SEQ ID NO: 3736 - DNA, 25 bp, Artificial Sequence
  Synthetic oligonucleotide
aagaugaggaagaaaucgaaguugt

SEQ ID NO: 3737 - DNA, 25 bp, Artificial Sequence
  Synthetic oligonucleotide
aagaugaggaagaaaucgauauugt

SEQ ID NO: 3738 - DNA, 25 bp, Artificial Sequence
  Synthetic oligonucleotide
aagaugaggaagaaaucgauggugt

SEQ ID NO: 3739 - DNA, 25 bp, Artificial Sequence
  Synthetic oligonucleotide
aagaugaggaagaaaucgauguagt

SEQ ID NO: 3740 - DNA, 25 bp, Artificial Sequence
  Synthetic oligonucleotide
aagaugaggaagaaaucgauguutt

SEQ ID NO: 3741 - DNA, 25 bp, Artificial Sequence
  Synthetic oligonucleotide
aagaugaggaagaaaucgauguuga

SEQ ID NO: 3742 - RNA, 27 nt, Artificial Sequence
  Synthetic oligonucleotide
ucaacaucgauuucuuccucaucuucu

SEQ ID NO: 3743 - RNA, 27 nt, Artificial Sequence
  Synthetic oligonucleotide
aaaacaucgauuucuuccucaucuucu

SEQ ID NO: 3744 - RNA, 27 nt, Artificial Sequence
  Synthetic oligonucleotide
acuacaucgauuucuuccucaucuucu

SEQ ID NO: 3745 - RNA, 27 nt, Artificial Sequence
  Synthetic oligonucleotide
acaccaucgauuucuuccucaucuucu

SEQ ID NO: 3746 - RNA, 27 nt, Artificial Sequence
  Synthetic oligonucleotide
acaauaucgauuucuuccucaucuucu

SEQ ID NO: 3747 - RNA, 27 nt, Artificial Sequence
  Synthetic oligonucleotide
acaacuucgauuucuuccucaucuucu

SEQ ID NO: 3748 - RNA, 27 nt, Artificial Sequence
  Synthetic oligonucleotide
acaacaacgauuucuuccucaucuucu

SEQ ID NO: 3749 - DNA, 25 bp, Artificial Sequence
  Synthetic oligonucleotide
aggaagaaaucgauguugauucugt

SEQ ID NO: 3750 - DNA, 25 bp, Artificial Sequence
  Synthetic oligonucleotide
aggaagaaaucgauguuguaucugt

SEQ ID NO: 3751 - DNA, 25 bp, Artificial Sequence
  Synthetic oligonucleotide
aggaagaaaucgauguuguuacugt

SEQ ID NO: 3752 - DNA, 25 bp, Artificial Sequence
  Synthetic oligonucleotide
aggaagaaaucgauguuguuuuugt

SEQ ID NO: 3753 - DNA, 25 bp, Artificial Sequence
  Synthetic oligonucleotide
aggaagaaaucgauguuguuucagt

SEQ ID NO: 3754 - DNA, 25 bp, Artificial Sequence
  Synthetic oligonucleotide
aggaagaaaucgauguuguuucutt

SEQ ID NO: 3755 - DNA, 25 bp, Artificial Sequence
  Synthetic oligonucleotide
aggaagaaaucgauguuguuucuga

SEQ ID NO: 3756 - RNA, 27 nt, Artificial Sequence
  Synthetic oligonucleotide
ucagaaacaacaucgauuucuuccuca

SEQ ID NO: 3757 - RNA, 27 nt, Artificial Sequence
  Synthetic oligonucleotide
aaagaaacaacaucgauuucuuccuca

SEQ ID NO: 3758 - RNA, 27 nt, Artificial Sequence
  Synthetic oligonucleotide
acugaaacaacaucgauuucuuccuca

SEQ ID NO: 3759 - RNA, 27 nt, Artificial Sequence
  Synthetic oligonucleotide
acaaaaacaacaucgauuucuuccuca

SEQ ID NO: 3760 - RNA, 27 nt, Artificial Sequence
  Synthetic oligonucleotide
acaguaacaacaucgauuucuuccuca

SEQ ID NO: 3761 - RNA, 27 nt, Artificial Sequence
  Synthetic oligonucleotide
acagauacaacaucgauuucuuccuca

SEQ ID NO: 3762 - RNA, 27 nt, Artificial Sequence
  Synthetic oligonucleotide
acagaaucaacaucgauuucuuccuca

SEQ ID NO: 3763 - DNA, 25 bp, Artificial Sequence
  Synthetic oligonucleotide
agcuuuuuugcccugcguaaccaga

SEQ ID NO: 3764 - DNA, 25 bp, Artificial Sequence
  Synthetic oligonucleotide
agcuuuuuugcccugcguguccaga

SEQ ID NO: 3765 - DNA, 25 bp, Artificial Sequence
  Synthetic oligonucleotide
agcuuuuuugcccugcgugaacaga

SEQ ID NO: 3766 - DNA, 25 bp, Artificial Sequence
  Synthetic oligonucleotide
agcuuuuuugcccugcgugacuaga

SEQ ID NO: 3767 - DNA, 25 bp, Artificial Sequence
  Synthetic oligonucleotide
agcuuuuuugcccugcgugaccuga

SEQ ID NO: 3768 - DNA, 25 bp, Artificial Sequence
  Synthetic oligonucleotide
agcuuuuuugcccugcgugaccata

SEQ ID NO: 3769 - DNA, 25 bp, Artificial Sequence
  Synthetic oligonucleotide
agcuuuuuugcccugcgugaccagt

SEQ ID NO: 3770 - RNA, 27 nt, Artificial Sequence
  Synthetic oligonucleotide
acuggucacgcagggcaaaaaagcucc

SEQ ID NO: 3771 - RNA, 27 nt, Artificial Sequence
  Synthetic oligonucleotide
uauggucacgcagggcaaaaaagcucc

SEQ ID NO: 3772 - RNA, 27 nt, Artificial Sequence
  Synthetic oligonucleotide
ucaggucacgcagggcaaaaaagcucc

SEQ ID NO: 3773 - RNA, 27 nt, Artificial Sequence
  Synthetic oligonucleotide
ucuagucacgcagggcaaaaaagcucc

SEQ ID NO: 3774 - RNA, 27 nt, Artificial Sequence
  Synthetic oligonucleotide
ucuguucacgcagggcaaaaaagcucc

SEQ ID NO: 3775 - RNA, 27 nt, Artificial Sequence
  Synthetic oligonucleotide
ucuggacacgcagggcaaaaaagcucc

SEQ ID NO: 3776 - RNA, 27 nt, Artificial Sequence
  Synthetic oligonucleotide
ucugguuacgcagggcaaaaaagcucc

SEQ ID NO: 3777 - DNA, 25 bp, Artificial Sequence
  Synthetic oligonucleotide
agguaguuauccuuaaaauagccac

SEQ ID NO: 3778 - DNA, 25 bp, Artificial Sequence
  Synthetic oligonucleotide
agguaguuauccuuaaaaaugccac

SEQ ID NO: 3779 - DNA, 25 bp, Artificial Sequence
  Synthetic oligonucleotide
agguaguuauccuuaaaaaaaccac

SEQ ID NO: 3780 - DNA, 25 bp, Artificial Sequence
  Synthetic oligonucleotide
agguaguuauccuuaaaaaagucac

SEQ ID NO: 3781 - DNA, 25 bp, Artificial Sequence
  Synthetic oligonucleotide
agguaguuauccuuaaaaaagcaac

SEQ ID NO: 3782 - DNA, 25 bp, Artificial Sequence
  Synthetic oligonucleotide
agguaguuauccuuaaaaaagccgc

SEQ ID NO: 3783 - DNA, 25 bp, Artificial Sequence
  Synthetic oligonucleotide
agguaguuauccuuaaaaaagccaa

SEQ ID NO: 3784 - RNA, 27 nt, Artificial Sequence
  Synthetic oligonucleotide
uuggcuuuuuuaaggauaacuaccuug

SEQ ID NO: 3785 - RNA, 27 nt, Artificial Sequence
  Synthetic oligonucleotide
gcggcuuuuuuaaggauaacuaccuug

SEQ ID NO: 3786 - RNA, 27 nt, Artificial Sequence
  Synthetic oligonucleotide
guugcuuuuuuaaggauaacuaccuug

SEQ ID NO: 3787 - RNA, 27 nt, Artificial Sequence
  Synthetic oligonucleotide
gugacuuuuuuaaggauaacuaccuug

SEQ ID NO: 3788 - RNA, 27 nt, Artificial Sequence
  Synthetic oligonucleotide
gugguuuuuuuaaggauaacuaccuug

SEQ ID NO: 3789 - RNA, 27 nt, Artificial Sequence
  Synthetic oligonucleotide
guggcauuuuuaaggauaacuaccuug

SEQ ID NO: 3790 - RNA, 27 nt, Artificial Sequence
  Synthetic oligonucleotide
guggcuauuuuaaggauaacuaccuug

SEQ ID NO: 3791 - DNA, 25 bp, Artificial Sequence
  Synthetic oligonucleotide
ccuaugaacuuguuucaauugcatg

SEQ ID NO: 3792 - DNA, 25 bp, Artificial Sequence
  Synthetic oligonucleotide
ccuaugaacuuguuucaaaagcatg

SEQ ID NO: 3793 - DNA, 25 bp, Artificial Sequence
  Synthetic oligonucleotide
ccuaugaacuuguuucaaauacatg

SEQ ID NO: 3794 - DNA, 25 bp, Artificial Sequence
  Synthetic oligonucleotide
ccuaugaacuuguuucaaauguatg

SEQ ID NO: 3795 - DNA, 25 bp, Artificial Sequence
  Synthetic oligonucleotide
ccuaugaacuuguuucaaaugcutg

SEQ ID NO: 3796 - DNA, 25 bp, Artificial Sequence
  Synthetic oligonucleotide
ccuaugaacuuguuucaaaugcagg

SEQ ID NO: 3797 - DNA, 25 bp, Artificial Sequence
  Synthetic oligonucleotide
ccuaugaacuuguuucaaaugcata

SEQ ID NO: 3798 - RNA, 27 nt, Artificial Sequence
  Synthetic oligonucleotide
uaugcauuugaaacaaguucauaggug

SEQ ID NO: 3799 - RNA, 27 nt, Artificial Sequence
  Synthetic oligonucleotide
ccugcauuugaaacaaguucauaggug

SEQ ID NO: 3800 - RNA, 27 nt, Artificial Sequence
  Synthetic oligonucleotide
caagcauuugaaacaaguucauaggug

SEQ ID NO: 3801 - RNA, 27 nt, Artificial Sequence
  Synthetic oligonucleotide
cauacauuugaaacaaguucauaggug

SEQ ID NO: 3802 - RNA, 27 nt, Artificial Sequence
  Synthetic oligonucleotide
cauguauuugaaacaaguucauaggug

SEQ ID NO: 3803 - RNA, 27 nt, Artificial Sequence
  Synthetic oligonucleotide
caugcuuuugaaacaaguucauaggug

SEQ ID NO: 3804 - RNA, 27 nt, Artificial Sequence
  Synthetic oligonucleotide
caugcaauugaaacaaguucauaggug

SEQ ID NO: 3805 - DNA, 25 bp, Artificial Sequence
  Synthetic oligonucleotide
ccaucuuuuuuuuuucuuaaacaga

SEQ ID NO: 3806 - DNA, 25 bp, Artificial Sequence
  Synthetic oligonucleotide
ccaucuuuuuuuuuucuuuuacaga

SEQ ID NO: 3807 - DNA, 25 bp, Artificial Sequence
  Synthetic oligonucleotide
ccaucuuuuuuuuuucuuuaucaga

SEQ ID NO: 3808 - DNA, 25 bp, Artificial Sequence
  Synthetic oligonucleotide
ccaucuuuuuuuuuucuuuaauaga

SEQ ID NO: 3809 - DNA, 25 bp, Artificial Sequence
  Synthetic oligonucleotide
ccaucuuuuuuuuuucuuuaacuga

SEQ ID NO: 3810 - DNA, 25 bp, Artificial Sequence
  Synthetic oligonucleotide
ccaucuuuuuuuuuucuuuaacata

SEQ ID NO: 3811 - DNA, 25 bp, Artificial Sequence
  Synthetic oligonucleotide
ccaucuuuuuuuuuucuuuaacagt

SEQ ID NO: 3812 - RNA, 27 nt, Artificial Sequence
  Synthetic oligonucleotide
acuguuaaagaaaaaaaaaagauggua

SEQ ID NO: 3813 - RNA, 27 nt, Artificial Sequence
  Synthetic oligonucleotide
uauguuaaagaaaaaaaaaagauggua

SEQ ID NO: 3814 - RNA, 27 nt, Artificial Sequence
  Synthetic oligonucleotide
ucaguuaaagaaaaaaaaaagauggua

SEQ ID NO: 3815 - RNA, 27 nt, Artificial Sequence
  Synthetic oligonucleotide
ucuauuaaagaaaaaaaaaagauggua

SEQ ID NO: 3816 - RNA, 27 nt, Artificial Sequence
  Synthetic oligonucleotide
ucugauaaagaaaaaaaaaagauggua

SEQ ID NO: 3817 - RNA, 27 nt, Artificial Sequence
  Synthetic oligonucleotide
ucuguaaaagaaaaaaaaaagauggua

SEQ ID NO: 3818 - RNA, 27 nt, Artificial Sequence
  Synthetic oligonucleotide
ucuguuuaagaaaaaaaaaagauggua

SEQ ID NO: 3819 - DNA, 25 bp, Artificial Sequence
  Synthetic oligonucleotide
uuuaacagauuuguauuuuagaatt

SEQ ID NO: 3820 - DNA, 25 bp, Artificial Sequence
  Synthetic oligonucleotide
uuuaacagauuuguauuuaugaatt

SEQ ID NO: 3821 - DNA, 25 bp, Artificial Sequence
  Synthetic oligonucleotide
uuuaacagauuuguauuuaaaaatt

SEQ ID NO: 3822 - DNA, 25 bp, Artificial Sequence
  Synthetic oligonucleotide
uuuaacagauuuguauuuaaggatt

SEQ ID NO: 3823 - DNA, 25 bp, Artificial Sequence
  Synthetic oligonucleotide
uuuaacagauuuguauuuaagautt

SEQ ID NO: 3824 - DNA, 25 bp, Artificial Sequence
  Synthetic oligonucleotide
uuuaacagauuuguauuuaagaagt

SEQ ID NO: 3825 - DNA, 25 bp, Artificial Sequence
  Synthetic oligonucleotide
uuuaacagauuuguauuuaagaata

SEQ ID NO: 3826 - RNA, 27 nt, Artificial Sequence
  Synthetic oligonucleotide
uauucuuaaauacaaaucuguuaaaga

SEQ ID NO: 3827 - RNA, 27 nt, Artificial Sequence
  Synthetic oligonucleotide
acuucuuaaauacaaaucuguuaaaga

SEQ ID NO: 3828 - RNA, 27 nt, Artificial Sequence
  Synthetic oligonucleotide
aaaucuuaaauacaaaucuguuaaaga

SEQ ID NO: 3829 - RNA, 27 nt, Artificial Sequence
  Synthetic oligonucleotide
aauccuuaaauacaaaucuguuaaaga

SEQ ID NO: 3830 - RNA, 27 nt, Artificial Sequence
  Synthetic oligonucleotide
aauuuuuaaauacaaaucuguuaaaga

SEQ ID NO: 3831 - RNA, 27 nt, Artificial Sequence
  Synthetic oligonucleotide
aauucauaaauacaaaucuguuaaaga

SEQ ID NO: 3832 - RNA, 27 nt, Artificial Sequence
  Synthetic oligonucleotide
aauucuaaaauacaaaucuguuaaaga

SEQ ID NO: 3833 - DNA, 25 bp, Artificial Sequence
  Synthetic oligonucleotide
cagauuuguauuuaagaaauguutt

SEQ ID NO: 3834 - DNA, 25 bp, Artificial Sequence
  Synthetic oligonucleotide
cagauuuguauuuaagaauaguutt

SEQ ID NO: 3835 - DNA, 25 bp, Artificial Sequence
  Synthetic oligonucleotide
cagauuuguauuuaagaauuauutt

SEQ ID NO: 3836 - DNA, 25 bp, Artificial Sequence
  Synthetic oligonucleotide
cagauuuguauuuaagaauuggutt

SEQ ID NO: 3837 - DNA, 25 bp, Artificial Sequence
  Synthetic oligonucleotide
cagauuuguauuuaagaauuguatt

SEQ ID NO: 3838 - DNA, 25 bp, Artificial Sequence
  Synthetic oligonucleotide
cagauuuguauuuaagaauuguugt

SEQ ID NO: 3839 - DNA, 25 bp, Artificial Sequence
  Synthetic oligonucleotide
cagauuuguauuuaagaauuguuta

SEQ ID NO: 3840 - RNA, 27 nt, Artificial Sequence
  Synthetic oligonucleotide
uaaacaauucuuaaauacaaaucuguu

SEQ ID NO: 3841 - RNA, 27 nt, Artificial Sequence
  Synthetic oligonucleotide
acaacaauucuuaaauacaaaucuguu

SEQ ID NO: 3842 - RNA, 27 nt, Artificial Sequence
  Synthetic oligonucleotide
aauacaauucuuaaauacaaaucuguu

SEQ ID NO: 3843 - RNA, 27 nt, Artificial Sequence
  Synthetic oligonucleotide
aaaccaauucuuaaauacaaaucuguu

SEQ ID NO: 3844 - RNA, 27 nt, Artificial Sequence
  Synthetic oligonucleotide
aaaauaauucuuaaauacaaaucuguu

SEQ ID NO: 3845 - RNA, 27 nt, Artificial Sequence
  Synthetic oligonucleotide
aaaacuauucuuaaauacaaaucuguu

SEQ ID NO: 3846 - RNA, 27 nt, Artificial Sequence
  Synthetic oligonucleotide
aaaacauuucuuaaauacaaaucuguu

SEQ ID NO: 3847 - DNA, 25 bp, Artificial Sequence
  Synthetic oligonucleotide
uguaaauaacuuuaauaauacgutt

SEQ ID NO: 3848 - DNA, 25 bp, Artificial Sequence
  Synthetic oligonucleotide
uguaaauaacuuuaauaaaucgutt

SEQ ID NO: 3849 - DNA, 25 bp, Artificial Sequence
  Synthetic oligonucleotide
uguaaauaacuuuaauaaaaagutt

SEQ ID NO: 3850 - DNA, 25 bp, Artificial Sequence
  Synthetic oligonucleotide
uguaaauaacuuuaauaaaacuutt

SEQ ID NO: 3851 - DNA, 25 bp, Artificial Sequence
  Synthetic oligonucleotide
uguaaauaacuuuaauaaaacgatt

SEQ ID NO: 3852 - DNA, 25 bp, Artificial Sequence
  Synthetic oligonucleotide
uguaaauaacuuuaauaaaacgugt

SEQ ID NO: 3853 - DNA, 25 bp, Artificial Sequence
  Synthetic oligonucleotide
uguaaauaacuuuaauaaaacguta

SEQ ID NO: 3854 - RNA, 27 nt, Artificial Sequence
  Synthetic oligonucleotide
uaacguuuuauuaaaguuauuuacauu

SEQ ID NO: 3855 - RNA, 27 nt, Artificial Sequence
  Synthetic oligonucleotide
acacguuuuauuaaaguuauuuacauu

SEQ ID NO: 3856 - RNA, 27 nt, Artificial Sequence
  Synthetic oligonucleotide
aaucguuuuauuaaaguuauuuacauu

SEQ ID NO: 3857 - RNA, 27 nt, Artificial Sequence
  Synthetic oligonucleotide
aaaaguuuuauuaaaguuauuuacauu

SEQ ID NO: 3858 - RNA, 27 nt, Artificial Sequence
  Synthetic oligonucleotide
aaacuuuuuauuaaaguuauuuacauu

SEQ ID NO: 3859 - RNA, 27 nt, Artificial Sequence
  Synthetic oligonucleotide
aaacgauuuauuaaaguuauuuacauu

SEQ ID NO: 3860 - RNA, 27 nt, Artificial Sequence
  Synthetic oligonucleotide
aaacguauuauuaaaguuauuuacauu

SEQ ID NO: 3861 - DNA, 25 bp, Artificial Sequence
  Synthetic oligonucleotide
cagaauuucaauccuaguuuauagt

SEQ ID NO: 3862 - DNA, 25 bp, Artificial Sequence
  Synthetic oligonucleotide
cagaauuucaauccuaguaaauagt

SEQ ID NO: 3863 - DNA, 25 bp, Artificial Sequence
  Synthetic oligonucleotide
cagaauuucaauccuaguauuuagt

SEQ ID NO: 3864 - DNA, 25 bp, Artificial Sequence
  Synthetic oligonucleotide
cagaauuucaauccuaguauagagt

SEQ ID NO: 3865 - DNA, 25 bp, Artificial Sequence
  Synthetic oligonucleotide
cagaauuucaauccuaguauauugt

SEQ ID NO: 3866 - DNA, 25 bp, Artificial Sequence
  Synthetic oligonucleotide
cagaauuucaauccuaguauauatt

SEQ ID NO: 3867 - DNA, 25 bp, Artificial Sequence
  Synthetic oligonucleotide
cagaauuucaauccuaguauauaga

SEQ ID NO: 3868 - RNA, 27 nt, Artificial Sequence
  Synthetic oligonucleotide
ucuauauacuaggauugaaauucugug

SEQ ID NO: 3869 - RNA, 27 nt, Artificial Sequence
  Synthetic oligonucleotide
aauauauacuaggauugaaauucugug

SEQ ID NO: 3870 - RNA, 27 nt, Artificial Sequence
  Synthetic oligonucleotide
acaauauacuaggauugaaauucugug

SEQ ID NO: 3871 - RNA, 27 nt, Artificial Sequence
  Synthetic oligonucleotide
acucuauacuaggauugaaauucugug

SEQ ID NO: 3872 - RNA, 27 nt, Artificial Sequence
  Synthetic oligonucleotide
acuaaauacuaggauugaaauucugug

SEQ ID NO: 3873 - RNA, 27 nt, Artificial Sequence
  Synthetic oligonucleotide
acuauuuacuaggauugaaauucugug

SEQ ID NO: 3874 - RNA, 27 nt, Artificial Sequence
  Synthetic oligonucleotide
acuauaaacuaggauugaaauucugug

SEQ ID NO: 3875 - RNA, 18 nt, Artificial Sequence
  Synthetic oligonucleotide
acgacgagaccuucauca

SEQ ID NO: 3876 - RNA, 20 nt, Artificial Sequence
  Synthetic oligonucleotide
ugaugaaggucucgucgucc

SEQ ID NO: 3877 - RNA, 20 nt, Artificial Sequence
  Synthetic oligonucleotide
ggacgacgagaccuucauca

SEQ ID NO: 3878 - RNA, 28 nt, Artificial Sequence
  Synthetic oligonucleotide
cggacgacgagaccuucaucaaaaacau

SEQ ID NO: 3879 - DNA, 25 bp, Artificial Sequence
  Synthetic oligonucleotide
aggaaccaugaccucgacuacgact

SEQ ID NO: 3880 - RNA, 27 nt, Artificial Sequence
  Synthetic oligonucleotide
agucguagucgaggucaugguuccugu

SEQ ID NO: 3881 - DNA, 25 bp, Artificial Sequence
  Synthetic oligonucleotide
agaaacuaugaccucgacuacaact

SEQ ID NO: 3882 - RNA, 27 nt, Artificial Sequence
  Synthetic oligonucleotide
aguuguagucgaggucauaguuucugu

SEQ ID NO: 3883 - DNA, 25 bp, Artificial Sequence
  Synthetic oligonucleotide
aagaacuaugaccucgacuaacgct

SEQ ID NO: 3884 - RNA, 27 nt, Artificial Sequence
  Synthetic oligonucleotide
agcguuagucgaggucauaguucuugu

SEQ ID NO: 3885 - DNA, 25 bp, Artificial Sequence
  Synthetic oligonucleotide
acaacgagaccuucaucaaaaacat

SEQ ID NO: 3886 - RNA, 27 nt, Artificial Sequence
  Synthetic oligonucleotide
auguuuuugaugaaggucucguugucc

SEQ ID NO: 3887 - DNA, 25 bp, Artificial Sequence
  Synthetic oligonucleotide
acgacaagaccuucaucaaaaacat

SEQ ID NO: 3888 - RNA, 27 nt, Artificial Sequence
  Synthetic oligonucleotide
auguuuuugaugaaggucuugucgucc

SEQ ID NO: 3889 - DNA, 25 bp, Artificial Sequence
  Synthetic oligonucleotide
acgacgagaccuucaucaauaacat

SEQ ID NO: 3890 - RNA, 27 nt, Artificial Sequence
  Synthetic oligonucleotide
auguuauugaugaaggucucgucgucu

SEQ ID NO: 3891 - DNA, 25 bp, Artificial Sequence
  Synthetic oligonucleotide
aagaugaagaagaaaucgauguugt

SEQ ID NO: 3892 - RNA, 27 nt, Artificial Sequence
  Synthetic oligonucleotide
acaacaucgauuucuucuucaucuucu

SEQ ID NO: 3893 - DNA, 25 bp, Artificial Sequence
  Synthetic oligonucleotide
aagaugaggaagaaaucgaaguugt

SEQ ID NO: 3894 - RNA, 27 nt, Artificial Sequence
  Synthetic oligonucleotide
acaacuucgauuucuuccucaucuucu

SEQ ID NO: 3895 - DNA, 25 bp, Artificial Sequence
  Synthetic oligonucleotide
aagaugaggaagaaaucgaugaugt

SEQ ID NO: 3896 - RNA, 27 nt, Artificial Sequence
  Synthetic oligonucleotide
acaucaucgauuucuuccucaucuucu

SEQ ID NO: 3897 - DNA, 25 bp, Artificial Sequence
  Synthetic oligonucleotide
aagaugaggaagaaaucgauagugt

SEQ ID NO: 3898 - RNA, 27 nt, Artificial Sequence
  Synthetic oligonucleotide
acacuaucgauuucuuccucaucuucu

SEQ ID NO: 3899 - DNA, 25 bp, Artificial Sequence
  Synthetic oligonucleotide
aagaagaaaucgauguuguuacugt

SEQ ID NO: 3900 - RNA, 27 nt, Artificial Sequence
  Synthetic oligonucleotide
acaguaacaacaucgauuucuucuuca

SEQ ID NO: 3901 - DNA, 25 bp, Artificial Sequence
  Synthetic oligonucleotide
agaaagaaaucgauguuguuacugt

SEQ ID NO: 3902 - RNA, 27 nt, Artificial Sequence
  Synthetic oligonucleotide
acaguaacaacaucgauuucuuucuca

SEQ ID NO: 3903 - DNA, 25 bp, Artificial Sequence
  Synthetic oligonucleotide
aggaaaaaaucgauguuguuacugt

SEQ ID NO: 3904 - RNA, 27 nt, Artificial Sequence
  Synthetic oligonucleotide
acaguaacaacaucgauuuuuuccuca

SEQ ID NO: 3905 - DNA, 25 bp, Artificial Sequence
  Synthetic oligonucleotide
aggaaaaaaucgauguuguuuucgt

SEQ ID NO: 3906 - RNA, 27 nt, Artificial Sequence
  Synthetic oligonucleotide
acgaaaacaacaucgauuuuuuccuca

SEQ ID NO: 3907 - DNA, 25 bp, Artificial Sequence
  Synthetic oligonucleotide
agcuuucuugcccugcgugaccaga

SEQ ID NO: 3908 - RNA, 27 nt, Artificial Sequence
  Synthetic oligonucleotide
ucuggucacgcagggcaagaaagcucc

SEQ ID NO: 3909 - DNA, 25 bp, Artificial Sequence
  Synthetic oligonucleotide
agcuucuuugcccugcgugaaccga

SEQ ID NO: 3910 - RNA, 27 nt, Artificial Sequence
  Synthetic oligonucleotide
ucgguucacgcagggcaaagaagcucc

SEQ ID NO: 3911 - DNA, 25 bp, Artificial Sequence
  Synthetic oligonucleotide
agcucuuuugcccugcguguccaga

SEQ ID NO: 3912 - RNA, 27 nt, Artificial Sequence
  Synthetic oligonucleotide
ucuggacacgcagggcaaaagagcucc

SEQ ID NO: 3913 - DNA, 25 bp, Artificial Sequence
  Synthetic oligonucleotide
agguaguuauccuuaaaaaacccac

SEQ ID NO: 3914 - RNA, 27 nt, Artificial Sequence
  Synthetic oligonucleotide
guggguuuuuuaaggauaacuaccuug

SEQ ID NO: 3915 - DNA, 25 bp, Artificial Sequence
  Synthetic oligonucleotide
agguaguuauccuuaaaaaaggcac

SEQ ID NO: 3916 - RNA, 27 nt, Artificial Sequence
  Synthetic oligonucleotide
gugccuuuuuuaaggauaacuaccuug

SEQ ID NO: 3917 - DNA, 25 bp, Artificial Sequence
  Synthetic oligonucleotide
agguaguuauccuuaaaaaaagccc

SEQ ID NO: 3918 - RNA, 27 nt, Artificial Sequence
  Synthetic oligonucleotide
gggcuuuuuuuaaggauaacuaccuug

SEQ ID NO: 3919 - DNA, 25 bp, Artificial Sequence
  Synthetic oligonucleotide
aggcaguuauccuuaaaaaagccac

SEQ ID NO: 3920 - RNA, 27 nt, Artificial Sequence
  Synthetic oligonucleotide
guggcuuuuuuaaggauaacugccuug

SEQ ID NO: 3921 - DNA, 25 bp, Artificial Sequence
  Synthetic oligonucleotide
ccuauaaacuuguuucaaaugcatg

SEQ ID NO: 3922 - RNA, 27 nt, Artificial Sequence
  Synthetic oligonucleotide
caugcauuugaaacaaguuuauaggug

SEQ ID NO: 3923 - DNA, 25 bp, Artificial Sequence
  Synthetic oligonucleotide
ccuaugaacuuguuucaaaugcutg

SEQ ID NO: 3924 - RNA, 27 nt, Artificial Sequence
  Synthetic oligonucleotide
caagcauuugaaacaaguucauagguc

SEQ ID NO: 3925 - DNA, 25 bp, Artificial Sequence
  Synthetic oligonucleotide
ccuaugaacuuguuucaaaugcaag

SEQ ID NO: 3926 - RNA, 27 nt, Artificial Sequence
  Synthetic oligonucleotide
cuugcauuugaaacaaguucauagguc

SEQ ID NO: 3927 - DNA, 25 bp, Artificial Sequence
  Synthetic oligonucleotide
ccuaugaacuuguuucaaauagctg

SEQ ID NO: 3928 - RNA, 27 nt, Artificial Sequence
  Synthetic oligonucleotide
cagcuauuugaaacaaguucauagguc

We claim:

1. An isolated double stranded nucleic acid (dsNA) comprising first and second nucleic acid strands comprising RNA, wherein said first strand is 19-35 nucleotides in length and said second strand of said dsNA is 27-35 nucleotides in length, wherein said second oligonucleotide strand comprises SEQ ID NO: 606 and reduces MYC target mRNA expression when said double stranded nucleic acid is introduced into a mammalian cell.

2. The isolated dsNA of claim 1, wherein starting from the first nucleotide (position 1) at the 3' terminus of the first oligonucleotide strand, position 1, 2 and/or 3 is substituted with a modified nucleotide.

3. The isolated dsNA of claim 1, wherein said 3' terminus of said first strand and said 5' terminus of said second strand form a blunt end.

4. The isolated dsNA of claim 1, wherein said first strand is 25 nucleotides in length and said second strand is 27 nucleotides in length.

5. An isolated dsNA comprising first and second nucleic acid strands comprising RNA, wherein said first strand is 25-35 nucleotides in length and comprises SEQ ID NO: 279 and said second strand of said dsNA is 19-35 nucleotides in length and reduces MYC target mRNA expression when said double stranded nucleic acid is introduced into a mammalian cell.

6. The isolated dsNA of claim 5, wherein said second strand of said dsNA comprises SEQ ID NO: 606.

7. The isolated dsNA of claim 2, wherein said modified nucleotide residue of said 3' terminus of said first strand is selected from the group consisting of a deoxyribonucleotide, an acyclonucleotide and a fluorescent molecule.

8. The isolated dsNA of claim 7, wherein position 1 of said 3' terminus of the first oligonucleotide strand is a deoxyribonucleotide.

9. The isolated dsNA of claim 1, wherein said dsNA comprises a modified nucleotide.

10. The isolated dsNA of claim 9, wherein said modified nucleotide residue is selected from the group consisting of 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and 2'-O-(N-methlycarbamate).

11. The isolated dsNA of claim 1, wherein said second oligonucleotide strand comprises a modification pattern selected from the group consisting of AS-M1 to AS-M73 and AS-M1* to AS-M73*.

12. The isolated dsNA of claim 1, wherein said first oligonucleotide strand comprises a modification pattern selected from the group consisting of SM1 to SM52.

13. The isolated dsNA of claim 1, wherein the amount of said isolated dsNA sufficient to reduce expression of the target gene is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

14. The isolated dsNA of claim 1, wherein said isolated dsNA reduces MYC target mRNA expression by an amount (expressed by %) selected from the group consisting of at least 10%, at least 50%, at least 80-90%, at least 95%, at least 98%, and at least 99% when said double stranded nucleic acid is introduced into a mammalian cell.

15. The isolated dsNA of claim 1, wherein the first and second strands are joined by a chemical linker.

16. The isolated double stranded nucleic acid of claim 1, wherein said 3' terminus of said first strand and said 5' terminus of said second strand are joined by a tetraloop.

17. The isolated double stranded nucleic acid of claim 1, wherein a nucleotide of said second or first strand is substituted with a modified nucleotide that directs the orientation of Dicer cleavage.

18. The isolated dsNA of claim 1 comprising a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2', 3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid.

19. The isolated dsNA of claim 1 comprising a phosphate backbone modification selected from the group consisting of a phosphonate, a phosphorothioate and a phosphotriester.

20. The isolated dsNA of claim 1 comprising a modification selected from the group consisting of a morpholino nucleic acid and a peptide nucleic acid (PNA).

21. A method for reducing expression of a target MYC gene in a mammalian cell comprising contacting a mammalian cell in vitro with an isolated dsNA of claim 1 in an amount sufficient to reduce expression of a target MYC mRNA in said cell.

22. The method of claim 21, wherein target MYC mRNA expression is reduced by an amount (expressed by %) selected from the group consisting of at least 10%, at least 50% and at least 80-90%.

23. The method of claim 21, wherein MYC mRNA levels are reduced by an amount (expressed by %) of at least 90% at least 8 days after said cell is contacted with said dsNA.

24. The method of claim 21, wherein MYC mRNA levels are reduced by an amount (expressed by %) of at least 70% at least 10 days after said cell is contacted with said dsNA.

25. A method for reducing expression of a target MYC mRNA in a mammal comprising administering an isolated dsNA of claim 1 to a mammal in an amount sufficient to reduce expression of a target MYC mRNA in the mammal.

26. A method for reducing tumor burden in a mammal comprising administering an isolated dsNA of claim 1 to a mammal in an amount sufficient to reduce tumor burden in said mammal.

27. The method of claim 26, wherein said tumor is a hepatocellular carcinoma.

28. The method of claim 26, wherein said tumor burden is reduced by 50-80%, as compared to a suitable control.

29. The method of claim 26, wherein said isolated dsNA is formulated in a lipid nanoparticle (LNP).

30. The method of claim 25, wherein said isolated dsNA is administered at a dosage selected from the group consisting of 1 microgram to 5 milligrams per kilogram of said mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

31. The method of claim 25, wherein MYC mRNA levels are reduced in a tissue of said mammal by an amount (expressed by %) of at least 70% at least 3 days after said isolated dsNA is administered to said mammal.

32. The method claim 31, wherein said tissue is liver tissue.

33. The method of claim 25, wherein said administering step comprises a mode selected from the group consisting of intravenous injection, intramuscular injection, intraperitoneal injection, infusion, subcutaneous injection, transdermal, aerosol, rectal, vaginal, topical, oral and inhaled delivery.

34. A method for selectively inhibiting the growth of a cell comprising contacting a cell with an amount of an isolated dsNA of claim 1 sufficient to inhibit the growth of the cell.

35. The method of claim 34, wherein said cell is a tumor cell of a subject.

36. The method of claim 34, wherein said cell is a tumor cell in vitro.

37. The method of claim 34, wherein said cell is a human cell.

38. A formulation comprising the isolated dsNA of claim 1, wherein said dsNA is present in an amount effective to reduce target MYC mRNA levels when said dsNA is introduced into a mammalian cell in vitro by an amount (expressed by %) selected from the group consisting of at least 10%, at least 50% and at least 80-90%.

39. The formulation of claim 38, wherein said effective amount is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

40. A formulation comprising the isolated dsNA of claim 1, wherein said dsNA is present in an amount effective to reduce target MYC mRNA levels when said dsNA is introduced into a cell of a mammalian subject by an amount (expressed by %) selected from the group consisting of at least 10%, at least 50% and at least 80-90%.

41. The formulation of claim 40, wherein said effective amount is a dosage selected from the group consisting of 1 microgram to 5 milligrams per kilogram of said subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

42. An isolated mammalian cell containing the isolated dsNA of claim 1.

43. A pharmaceutical composition comprising the isolated dsNA of claim 1 and a pharmaceutically acceptable carrier.

44. A kit comprising the isolated dsNA of claim 1 and instructions for its use.

45. A method for treating or preventing a MYC-associated disease or disorder in a subject comprising administering the isolated dsNA of claim 1 and a pharmaceutically acceptable carrier to the subject in an amount sufficient to treat or prevent said MYC-associated disease or disorder in said subject, thereby treating or preventing said MYC-associated disease or disorder in said subject.

46. The method of claim 45, wherein said MYC-associated disease or disorder is selected from the group consisting of liver, renal, breast, lung, ovarian, cervical, esophageal, oropharyngeal and pancreatic cancer.

47. The method of claim 46, wherein said MYC-associated disease or disorder is hepatocellular carcinoma.

48. A composition possessing MYC inhibitory activity consisting essentially of an isolated dsNA of claim 1.

49. An isolated dsNA comprising first and second nucleic acid strands comprising RNA, wherein said first strand is 19-35 nucleotides in length and said second strand of said dsNA consists of SEQ ID NO: 606 and reduces MYC target mRNA expression when said double stranded nucleic acid is introduced into a mammalian cell.

50. An isolated dsNA comprising first and second nucleic acid strands comprising RNA, wherein said first strand consists of SEQ ID NO: 279 and said second strand of said dsNA is 19-35 nucleotides in length and reduces MYC target mRNA expression when said double stranded nucleic acid is introduced into a mammalian cell.

51. The isolated dsNA of claim 50, wherein said second strand of said dsNA consists of SEQ ID NO: 606.

\* \* \* \* \*